United States Patent 11,098,302 (IDENTIFICATION OF POLYNUCLEOTIDES ASSOCIATED WITH A SAMPLE) - sequence listing, part 87

SEQ ID NO: 301962 - DNA, 578 bp, Homo sapiens
  misc_feature: GZ8MTXP02GW0FM.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
  modified_base (569)..(569): a, c, t, g, unknown or other
  misc_feature (569)..(569): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgccggccagtcagagcgttaggacgtaacttagcctggtatcagcagagcctggcaggctccagacctcctnatctttggccgtacctttaacgaggggccagtggaactcccagccaggttcagcggnacggtgggtctggtacttcgtcactctacacatacaatactnacatctagactattgacttagtttattctgtcagactagtctagaacgtacgtcggttccgtacctaccggttacggacggggaacgggtaaccgaacgggtacggaaccgtaacgaaaacgtagtggttacggctacggacacctattcgtaagttcctacgtacttaccttacccnctacttacg

SEQ ID NO: 301963 - DNA, 622 bp, Homo sapiens
  misc_feature: GZ8MTXP02GXPI3.8.28.C06.1.454.CMB.2.raw
  modified_base (433)..(433): a, c, t, g, unknown or other
  misc_feature (433)..(433): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgtaccctttaacgacgggtaccaggtggaaactccccgaaggccctaggttccaggccggcaacggtggggtctacggggtactttcggtccaactccgtacaaccataccaaactaaccctgacaaatcgtanacgtacttgctagtttactttctgtcagcagtctagaagactgccgttcacgtttcgggacgggtaggaaccctaagggtcgaacccgtacgtaaaacggaccttaggtacggccgttacggacctaaaccccgttctaccgttaacgtaccttacctaccgttcccgttacccccgaccgtacgtccg

SEQ ID NO: 301964 - DNA, 637 bp, Homo sapiens
  misc_feature: GZ8MTXP02J05PQ.8.28.C06.1.454.CMB.2.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggcagtcagngcgtagacgaacttgctggtatcagcagaggctggccaggctcccagactcctnatcgtttggccgtcctttaacgngggccagtggaactcccagccaggttcagcggcaggtggtcgtgggtacttcgttcactctcaaccntcaactaacctgacaaactcctagacgtactttaggcttagttttacttcgtcgttacagtacaggttactagaaacgtattcgggacccgtttcgtaccgtttcggggaccgggtaacgggtaacccgtaaagggttccgggaaacccttaacgaaaaccggtaaccgtacggtagggtacccgtacgaccgtaacccgtagttaccgttaacgttaccgttaccgttaccttacccgttaccccgtacccgtaccgtacg

SEQ ID NO: 301965 - DNA, 574 bp, Homo sapiens
  misc_feature: GZ8MTXP02FOBBU.8.28.C06.1.454.CMB.2.raw
  modified_base (197)..(197): a, c, t, g, unknown or other
  misc_feature (197)..(197): n is a, c, g, or t
  modified_base (393)..(393): a, c, t, g, unknown or other
  misc_feature (393)..(393): n is a, c, g, or t
  modified_base (432)..(432): a, c, t, g, unknown or other
  misc_feature (432)..(432): n is a, c, g, or t
  modified_base (537)..(537): a, c, t, g, unknown or other
  misc_feature (537)..(537): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagagcctggccaggctcccagactcctcattctttggcgtacctttaacgacgggccaggtcggaatccccgagccaggttcagcggcagtgggtctgggacttcgtcactctcacatacaagtaaccngacaatctagacgtactttgacttagtttactttctgtnacgctagtctagaagtactcggtcttcgtaaccgtttcgggacggaacgggtaccgaagggtcggtaacctacgaaaacgtacgtaggtcggctcggacctaacncttactcgttctactactccctttacccgcctactcg

SEQ ID NO: 301966 - DNA, 603 bp, Homo sapiens
  misc_feature: GZ8MTXP02G2P3Q.8.28.C06.1.454.CMB.2.raw
  modified_base (167)..(167): a, c, t, g, unknown or other
  misc_feature (167)..(167): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacanagtctccggtcaccctgtctgtttttccngggganagagccaccctctcctgtgcggccagtcagagcgttaaggacaacttagccttggtatcagcagagcctggccaggcctcccagacctcctcattcgttggcgtacctttaacgngggtcccaggtaggaactcccagcctaggttcagcggcacggtgggtctgggtacttcgtcnctctcacntacaataaccngactaatctagacgtactttgacttagtttacttcgtgtactagtacgtagtcgttaggaacgtacgttcgggtaccgtttacgtacggtttaccgggacgggtaacgggaccggtaagggtacggaaccttacgaaaacgtacgtggtacggctacgacctacctattcgtaacgttctactacgttcctcccgtactacttcg

SEQ ID NO: 301967 - DNA, 713 bp, Homo sapiens
  misc_feature: GZ8MTXP02H1LVG.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctccagagatcattggagaagtggtgatgacacagtctccggtcacctgtcttgtttttccgngggganagagccacctctctgtcgcggccagtcagagtcgttaggacgtaacttagcctaggtatcagcaggacggcctggccaggcctacccgagtacctcctctacttcgtttcggaccttacttaacgacgggacctaggtacggaaactccccgagtccgtacggttacacggcggacgtagggttcggggtacgttgggggtaacctttcggttaccaaccgttcctaccaaacctaacttacctaaaattaaacccgtgaactaaacttcgttacgtaacggttactttcggactttaggttttactttacgttacgttaaccgtaggtacgttaacgttcgttaaggtaaacgtacggttacgggttcccgtttacggttaccggtttacggggaacggggtaaacggggtaacccgtaaggggttaccgtaaccgttaaacggaaaaccgtacgttacggtacgcgtaacgctaacgtacgtctacgttctttactccg

SEQ ID NO: 301968 - DNA, 821 bp, Homo sapiens
  misc_feature: GZ8MTXP02JH3I3.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagacgcccaccctctcctgtcgccggcagtcagagtcgttaggacgtaacttagcctaggtatcgagcaggacgccgtcggccgacggcctacccgagtacctcccgtctacttccgtttcggccgttacccgtttaacggacgggtacctaaggtcggaaacctccccgaaggtcccgtaacgggttccgaaggtccggggtacgtaccggggtttcggggtccggttacggggttaccttttcggttaccctaccttccttaacccaaccctattaaccctaaacgtaaaccctcgaacttaaacgtccgttaacggtaaccggtttactttacgtaccgtttagtttttacgtttcgttacggttactaaacggtccttaaggttccgtttaaacgggaaacggtttccggtaccggtttaccccggtttaccgttacccggggtttaccgggggacgggggtaaccgggtaaccggtaacggggtaccggttaacccgtaacggtaaaaccggtacggttgggtaaccggtcgtaccgtacctaacccgttagtttaccgttccgtttacccttaccgttaccttccccggtaacccctaccgtttacttaccgg

SEQ ID NO: 301969 - DNA, 597 bp, Homo sapiens
  misc_feature: GZ8MTXP02GFBPR.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattctttggcgtcctttaacgngggccagtagaaactcccagcctaggtcagcggcaggtgggtctgggacttcgtcactctacaccatacaatacctgaccaatctagacgtacttgcttagtttatttctgtcagctagtctaggaataccgtgggtcccgttacgtaccgtttcgggacgggtaacgggaacccgtaagggtacggacccgttaacgaaaacggtaacgtgggtacgtacgtacgacctaacctagttaccgttcgtacttacctacttcccgtttacccgaccttactcg

SEQ ID NO: 301970 - DNA, 667 bp, Homo sapiens
  misc_feature: GZ8MTXP02FXERW.8.28.C06.1.454.CMB.2.raw
  modified_base (196)..(196): a, c, t, g, unknown or other
  misc_feature (196)..(196): n is a, c, g, or t
  modified_base (264)..(264): a, c, t, g, unknown or other
  misc_feature (264)..(264): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagcccaccctctccgtgtcgccggccagtcagagcgttaaggactaacttagcctggtancagcagaggcctggccaggctcccagtacctcctacattccgtttggccgtacctttaacgacggaccctaggtacggaactccccgagccgtaacggttcgaggtccgggctacggtcggggtccgtaggggtactttcggttccactccgtacaaccgtataccaataacctgactaatctagacgttacttgacttagttctttctagtctagctagttctaggtaacgcggttccgttacgacggtttaccgggcggggtaacggacccggtaagggtaccggtaaaccgtaacgaaaccggtaacggttcggtaacggttcgtacgccgttaacgtaaccgttcgtccgtttaaccgtcttaaccgttcccgtaacccgtcctaacttccgtaaacgg

SEQ ID NO: 301971 - DNA, 674 bp, Homo sapiens
  misc_feature: GZ8MTXP02GBC58.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagacgccacctctcctgtgcggcagtcagagcgttaggacgtaacttagcctggtatcgagcaggaggcctggccagggcctcccagtacctcctcacttcgtttggccgtacctttaacgacggggtccaggtcggaactccccgagcctaggttcaggccggacgacgggtcggggtcgtggggtactttcggttaccacgttcctaccaacctattaccaaactaacctgactaaacttcgtacgtacgtactttgaccgttagttttactttcgttgtacagtctagttcgtaggtaacgtacgttcgggtaccgttacgtaccgtttcggggacgggtaacgggaaccgtaagggtacggtaacccgtaacgtaaaacggtacgtggtacgggtacctacggacctaccgtacgttccgttaacggtttccttaccgttacttcccgttacccgactaacgtttccgg

SEQ ID NO: 301972 - DNA, 787 bp, Homo sapiens
  misc_feature: GZ8MTXP02JPFBQ.8.28.C06.1.454.CMB.2.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagattcattggagaagtggtgatgacacagtctccggtnacctgtctgttttccngggganagngccacctntcctgtgcggccagtcagagcgttaggacaacttagcctggtatcagcagaggcctggccaggctacccgagtacctcctactacttcgttacggccgtacccttttaaaccggacggggtccctaaggtacgggaaaacttcccccgaaaggtccccgtaaaggggtttccaacgggccggaccgtaagggtacggggttcgtcgggggttactttacccgggtttacgaccgttacccgtacctaaacccctagttacccgaaaaacgttaaaccccttggaacctaaaacttccgttaacgggaaccgttaaacccttttgggaccttaggtttttaccgtttaacttcgggttacccaaagggttccctaaaggtttcccgttaagggaaaaactacccggttaacggtccccggtttaaacgttaccggtttcccggggagggtaacggggtaaaccgaacggggttaccgaacccggtaacgttaaaaaccggcgtaacggggttctaccggtaacgaccgaaccccgtattaccctaggtttacccctttacgtaccg

SEQ ID NO: 301973 - DNA, 824 bp, Homo sapiens
  misc_feature: GZ8MTXP02JF63A.8.28.C06.1.454.CMB.2.raw
  modified_base (276)..(276): a, c, t, g, unknown or other
  misc_feature (276)..(276): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgccaccctctcctggtcgcggcagtcagagcggttaggacgtaacttacgcctggtactcagcgaaggnggccgtggccgacggccctcccgagtacctcctacactttcgtttcggaccgttaacccgtttaacggacggggtaccctaaggtccgggtaaacctacccccggtaacggccgttaaacggggttccaacggggtccggtaccggtaacggggttcggggttaccggttaccggggttaccgttttccggtttaccaaccgtttccctaaccctaaccttaaacttaaaccgtaaaacctttaaacccgtacggtaacccttaaaactttccgttaaacggttacccgttaacgttttaccggttaacttttaacgtttttacgtttcgtcgtaacgtacgtacgttacggtacgttagtaacggttaccgttcccgggttaccgtttacggtaccgggttttcggggaccgggtaacggggtaccgtaacggggtacgtaaaccgtaaccggtaaaacgtacggttcggtacgtacgtacggacctaaccggtagttcctaacgtttccttacggacccttaccggtaccctcgtacgtttaccgg

SEQ ID NO: 301974 - DNA, 635 bp, Homo sapiens
  misc_feature: GZ8MTXP02JH1B9.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtgcggccagtcagagcgttaggactaactagctggtatcagcagacggcctggccaggcctcccagacctcctacnttcgtttcggaccgttacctttaacggacggggccaggtcggaactccccgagccgtaggttcaggcggctggtcgggtctggtcttcgtcacttctcaccntaccaataccnactactctacgacgtacttgtactttagtttacttcgtgtacacgtactagttacgtaacggacgtaccgtcgggttccgttaccgtaccggttcggggacgggtaacgggaccgtaaggggtacgaaccgtaacggtaaaacgtacggtcggtacggctaccggacctaccgtacgtccgttaacgtcctttaccgtaccttcccgttacccgtacctacgtcg

SEQ ID NO: 301975 - DNA, 630 bp, Homo sapiens
  misc_feature: GZ8MTXP02FML64.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctgtgccggccagtcagagtcgttaggacgaacttagcctggtatcagcagaggcctggccaggcctcccagacctcctcatcgtttggccgtcctttaacgacgggccaggtcggaactccccgagtccgtaggttccaggccggcgtaggtcggggtctggggtacttcgtccactcctacactatacaaactacgtgactaatctagactactttgacgtttagtttactttcgtgtacagtcgtagtctagtaacgtacgtcggttaccgttacgtacccgtttcggggaccgggtaacgggtaccgtaaagggtcgaaacccgtaacgaaaaccggtagttggtacggactacgaccgtactagttccgtaagttcctactaccttccgttacccgacctagtccg

SEQ ID NO: 301976 - DNA, 616 bp, Homo sapiens
  misc_feature: GZ8MTXP02FF2IW.8.28.C06.1.454.CMB.2.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (385)..(385): a, c, t, g, unknown or other
  misc_feature (385)..(385): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagactcctcatctttggcgcctttaacgngggccaggtggaatcccagccaggttcagcggcaggtgggtctggggacttcgtcactctcacatcaataacngcaaatctagacgtactttgcttagttatttcgtgtcacgctaagtctaggaacgacgttcggtaccgtttcgaccgttttacgggcgggtaacggggtaccgtaaaggggtcggtaacccgtaacgaaaacgtaaccgtaggttcgggaccttacggcccaaaccgtacttaccgtcggtttacctttacctaaccgtttcccgtttaccccggaccctaacgtttcccg

SEQ ID NO: 301977 - DNA, 803 bp, Homo sapiens
  misc_feature: GZ8MTXP02I1W2N.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagccaccctctcctgtcgcggccagtcagagtcgttaggacgaacttagcctggtatcagcgagacggctggccaggcctccacgacctcctctattcgtttcggccgtacctttaacgacgggtacccaggttaggaaacctccccgagtccgtaacggtttcgaacggtccggtacgtacggggttcggggttaccgttacggggtaaccttttccggttaccgtaacctttccctacctaaaccctacttaccctaaaacttaacccctagtaacctaaacttccgtaacggtaaccgttaaaccgtttttcggtaacctttaggtttttaaactttttcgttacggttaactacgtacgttaacgttaccgttaaggtaaacggttaccgttacgggtcccggtttacttaaaccggtttccggggaacgggtaacgggaaacccggtaaaggggttaccggtaaacccgtaacgtaaaaccggtaaacgttcgggtaacgggtcgttaacggacccgtaaccgttaacttccggtttaacgttccgtttaccgttaccgttccccgtttacccccgtactaccgtttaaccgg

SEQ ID NO: 301978 - DNA, 569 bp, Homo sapiens
  misc_feature: GZ8MTXP02JTMGR.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (320)..(320): a, c, t, g, unknown or other
  misc_feature (320)..(320): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggctccttaacgngggccagtggaactcccagccaggttcagcggcaggtgggtctggggtacttcgtcactctcacatacaataccctgacaatctgaccgtactttgcttagtttactttcgtgtcagtctagtcgtagaacgtacgtcggtccgttactacgtttcggggacgggtacgggaaccgagggtcgaaccgtacgaaaacgtaccgtggtaggacctaaggaacctatacgtcgtaccttacactttccccg

SEQ ID NO: 301979 - DNA, 580 bp, Homo sapiens
  misc_feature: GZ8MTXP02G9QR8.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
  modified_base (517)..(517): a, c, t, g, unknown or other
  misc_feature (517)..(517): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccacctctcctggtgcggccagtcagagcgttaggactaacgttagcctggtatcagcagagctggccaggcnccagctctcatctttggccgtctttaacgacgggccaggtggaactcccagcctacggtacaggcggacaggtcgggtcgtgggacttggtccacgtctcaccatacaagtacngacaatctagactacttnctaagtttctttactgtcagtnagtctagacgtacgtcggtccgttactacgttcgggacggacgggtaaccagggtaggacctacgaaaacggtacgtgtacggntacggctaacccggattctaacggttccttaccgtactttacccgtaccccgtctaacttcgg

SEQ ID NO: 301980 - DNA, 670 bp, Homo sapiens
  misc_feature: GZ8MTXP02IRDJ4.8.28.C06.1.454.CMB.2.raw
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (477)..(477): a, c, t, g, unknown or other
  misc_feature (477)..(477): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacanagtctccggtcaccctgttcttgtttttccgnggggagagacgccacctctcctgtcgcggccagtcagagcgttagactaatgcctgtatcagcaggacgcctcggcacggcctacccgacgtacctcccgtactatttccgtttcggaccgttacccgtttaaacggacgggtacccgtaggtacgggtaaacccttcccgaacggcccgttagggtccacggggccggtacgtacggggtttcggggttccgtacggggtaccttttcggtacctactccgtaccaccgtaataacctaaacttaaccngaactaactccgtagtaccgttctttgactttattttacgttctcggtacagtctagtacgtagaacgtcgtcggtaccgttcgtacggttcggacgggtaacggtacggtaacggtcgaacgtaacgaaacgtcgtaggtcggctacgaccacttcgttctcgttctacgtcttccgtaccctctactacgg

SEQ ID NO: 301981 - DNA, 764 bp, Homo sapiens
  misc_feature: GZ8MTXP02GICH1.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctctgtgcgccagtcagagtcgttaagacgtaacttacgcgtagtatcagcgaggacggctggaccaggcccgtaccagtacctcctactacttcgtttcggccgtacctttaaacgacggggaccaggtacggaacctaccccggagaccgtaaggttacgacggacggccgtaaggtcggggttacgtacggggttaccttacgttaccacttcctaccaacctactacctaaaactaaccgtgaaactaactcgtagtaccggtactttaggtaccgttaattttaacgtttcgtacgttcaaacggcctaaagttacccgtaaggtaaacggtaccgttcgggtccccgtttacgtaaacccgtttcgggggaacccgggggaacggttaaaccggaaacgggggtttccgaaaaccgtaaaaccgtaaaacggtaaaacccggttttggggacggtacttcggtaacccaaaaccgttcgttaaccggttgttaccccttttcaaaaccggttcccctttaccccggtacctacgtttaaccgg

SEQ ID NO: 301982 - DNA, 662 bp, Homo sapiens
  misc_feature: GZ8MTXP02H7I1U.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (448)..(448): a, c, t, g, unknown or other
  misc_feature (448)..(448): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtcttgtttttccgngggganagacgcccacctntcctgtcgcggccagtcaggagtcgttaaggacgtaacttgcctggtactcgagcaggacggccctaggccacggacctcccagtacctcctctattcgtttcggccttacccgttaaagcgggacctaaggtcggaaactcccgaggtcccagggttccaagggtccgcggtacggtgggtacgtcgggtacttcggttacactctaccaacactacgaaaacttaccgngactaatcctagtaccgtagtttcgctttaagttttctcgtataccgagtacgtagtcgtaagtaacgtcgtacggtaccgttcgtaccgggttacgggacgggtaaacggacgtaacgggtaccgtaaaccgtaacgtaaacgtacggtggtacgcgtacacctactacgttacgtcgttacctccgttacctcccgtacccgtactacgtcg

SEQ ID NO: 301983 - DNA, 619 bp, Homo sapiens
  misc_feature: GZ8MTXP02IIMCN.8.28.C06.1.454.CMB.2.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagacgccaccctctcctgtgcggccagtcagagcgttaggacaacttagcctggtatcagcagaggctggccaggctcccagacctcctacagttctttggcctacctttaacacgggccaggtaggaactccccgagccgaggttcaggcggcaggtcgggtctgggtacttcgtcactctcacatacaatacctgacaatcagactactttgacttagttttacttctgtcagcagttctaggaacgtacgttcgggtccgttacgtaccggtttcgggacgggtaacggggtaaccgtaaagggttacggtaacccgtaacgtaaaaacggtacgttacggtcggtacctacggtaccgtaaacctatccgttaacgttccttactaccttacctttccccgacttactacg

SEQ ID NO: 301984 - DNA, 678 bp, Homo sapiens
  misc_feature: GZ8MTXP02FGOB0.8.28.C06.1.454.CMB.2.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (338)..(338): a, c, t, g, unknown or other
  misc_feature (338)..(338): n is a, c, g, or t
  modified_base (391)..(391): a, c, t, g, unknown or other
  misc_feature (391)..(391): n is a, c, g, or t
tcagctcgcgtgtccacgaccggtgctcgatttagagctcacgtattgggtttggggagagctctggggaggaactgctcagttaggacccagacggaaccatggaagcccccagcgcagcttctcttcctcctgctactctggctcccagagatcattggagaagtggtgatgacacagtctccggtcaccctgtctgtttttccnggggagagagccacctctctgtgcgccagtcagagcgttaggactaatagcctggtancagcaggacggcctggccaggcctaccagactcctcattcgtttggcgtcctttaacgagggccaggtgaacnccagcacggttcacgcgcgaggtggtcgtcgggtaccttgttccgactcctanacctatacaaactaacctcgactactacgtacgaccgtactttagacttaacgtttactttcgtcgtactacgtgtacgttacgtaaggaacgttacggtacgggttacccgtttccgtaacggttttacccggggaaccggggtaacgggggtaaacccgtaaacgggggtccggtaaaccccgtaaaccggtaaaaccggtaaaacgtacggggtccgggttaccgtaacggtaccctaaacccggttacgttaccgtttaacgttcgttaccctttaaccccgg

SEQ ID NO: 301985 - DNA, 683 bp, Homo sapiens
  misc_feature: GZ8MTXP02FLTRZ.8.28.C06.1.454.CMB.2.raw
  modified_base (211)..(211): a, c, t, g, unknown or other
  misc_feature (211)..(211): n is a, c, g, or t
  modified_base (343)..(343): a, c, t, g, unknown or other
  misc_feature (343)..(343): n is a, c, g, or t
  modified_base (490)..(490): a, c, t, g, unknown or other
  misc_feature (490)..(490): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatggacacagtctcggtcaccctgtctgttttcctgggganagacgccacctctctgtcgcggccagtcagtagcgttaggacgtaattagcctggtatcagcagaggctcggccaggcctccgagactcctcattcgtttggctacctttaacgagggccaggtagtaaacncccgagtcctacggtcacgtacggactagtcggggtcgtggggtaccttcggtctacctcgtaccaactctaaacctaacttaaaccgtgtacctaaaagttccgttacggacgttaacgtttcgaactttacgtttaactttcgtntacgtacgactagttacgtaagaactaccggttacggccgtttacgaccggtttcgggacggggtacggggaaccccgtaaaaggggtttcccggggaaaacccttaagaaaacccggtttacgtacgggtaccggtaacgttccggtaccgaaccctaaacggtcctttaacgggtacctttaccggtaacc

SEQ ID NO: 301986 - DNA, 550 bp, Homo sapiens
  misc_feature: GZ8MTXP01ETUFX.11.40.D07.1.454.CMB.2.raw
  modified_base (234)..(234): a, c, t, g, unknown or other
  misc_feature (234)..(234): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccnccaggctccaggcaaaggggactggagtggctatcatttatgtcatttgatggaactaatatatactattctgggggccgttaagggtcgatttcaccatctccagagaccaattcaggaacacgctgtaatctgcaaattacacagcccganaactgacgacaacggcttagtttattacngtgccaanagatagtacgacgtaaattagcgaggggtgacaagtactagtacaatactaatttcgacctaaacgttcggggaccgaacgggaacccgttggttacaagtcgtctcctcacgtccttccgaaccg

SEQ ID NO: 301987 - DNA, 597 bp, Homo sapiens
  misc_feature: GZ8MTXP01EDYYX.11.40.D07.1.454.CMB.2.raw
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
  modified_base (470)..(470): a, c, t, g, unknown or other
  misc_feature (470)..(470): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtggggggaggcgtggtccagcctgggaggtccctgagactctcctgtgcagcctctggattcatcttcaatacctttggcatgcactgggtcccgccaggctccaggcaaggggactgggagtggctatcatttangtcatttgataggaactaatatatactattcgtgggggaccttaagggtcatttcacctatctaccagagaaccaattacaaggaaaccacgactgtaatctagactaaattacacacgaccccganaactgaacgacacggtcttagtttacttactgtcgaccacaagatagtacgacgtaaatttacgngaggggtgacctagtacagtcaagttactaatttcgaccgtaaacggttcgggggaccctaaggggaaccccttgggttacctaacgttccgttcctccctcaccggtccccttaacccgaacccgg

SEQ ID NO: 301988 - DNA, 559 bp, Homo sapiens
  misc_feature: GZ8MTXP01BCPM2.11.40.D07.1.454.CMB.2.raw
  modified_base (234)..(234): a, c, t, g, unknown or other
  misc_feature (234)..(234): n is a, c, g, or t
  modified_base (272)..(272): a, c, t, g, unknown or other
  misc_feature (272)..(272): n is a, c, g, or t
  modified_base (356)..(356): a, c, t, g, unknown or other
  misc_feature (356)..(356): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccncaggctccaggcaagggactggagtggctatcatttangtcatttgatggaactaatatatactattcgtggggaccgttaagggtcgatttcaccatctccagagaccaattccaggaacncgctgtaatctgactaaattaccacacgaccccgacaactagacgacacggtcttagtttattactgtcgaccaacagatagtacgacgtaatttagcgaggggtgccagtacagtcatactaatttcgacctaacgttcggggaccaacgggttaacccgttggttaccaatccgtcctcctcgacgtcccttccgaacccg

SEQ ID NO: 301989 - DNA, 562 bp, Homo sapiens
  misc_feature: GZ8MTXP01D7U20.11.40.D07.1.454.CMB.2.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccnccaggctccaggcaaggggactggagtggctatcatttangtcatttgatggaactaatatatactattcgtggggaccgttaagggtcatttcaccatctcagagaccaatcaggaacacgctgtaatctgacaaattacacacgcccgaacaactgacgacacggcttagtttatactgtgaccaananatagtacgagtaattagacgagggtcgactaagtactagtactatactaattcgaccgtaacggttcggggaccgtaacgggttacccgttggttactaactccgtcctcccgcgaccgtcccttaacccgaaccg

SEQ ID NO: 301990 - DNA, 647 bp, Homo sapiens
  misc_feature: GZ8MTXP01AP03M.11.40.D07.1.454.CMB.2.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtggggaggcgtggtccagcctgggaggtccctgagactctcctgtgcagcctctggattcatcttcaattacctttggcatgcacgtgggtccgccaggcctccgaggcaaggggactggagtggctatcatttatgtctatttgatagaaactaatatatactattcgtggggccgttaagggtctattcacatcncaganacatcagacncgctgtnctgacaataccacacgacccgaanaactcgaacgaccgacggtctttagttttaacttactgtaccgccaaacgtagtaactacgtaaccggtagttaaactttagggaccggtaggggggtccgacccgtaaggttacctagttacccaaatttaccgtaattttacccggacccgtaaacgggttcgggggaaacccctaaacgggggttaacccccttggggttacccaacgtttcccggtccttccccgtaccaccggtccccttaaccccgaaaccccggg

SEQ ID NO: 301991 - DNA, 697 bp, Homo sapiens
  misc_feature: GZ8MTXP01ADSS9.11.40.D07.1.454.CMB.2.raw
  modified_base (236)..(236): a, c, t, g, unknown or other
  misc_feature (236)..(236): n is a, c, g, or t
tcagcgagagataccacgaccggtgctcgatttagtgatagagcgtaacgaacagaggactcaccatggagtttgggctgacctgggttttcctcgttgctcttttaagaggtgtccagtgtcaggtgcagctggtggagtcgtgggggagcgtggtccagcctgggagtccctgagactctcctgtgcagcctctggattcatcttcaatacctttggcagtgcacgtgggtccncaggtctccgaggcaagggctggagtggctatcattatgtcattgatggaaactaatatatactagttcggtgggggtaccgtttaaagggtcgtactttaccaaccgtattccgtaccaaggtaacgtaacccctaaacgttaccaaaggggtaaaccctaccggtacttacgttaactccgtaggtaactaaactttacccgaactaccgtaccccgaacctaaaccgtacggaaccgaaccgtacgggtacttacggtttacttaccgtagtcgacccataagtactaacgttaacgacgtaaagtttacggacgtacgggggtcgaccgtaacgttacgaagttacctaagttactaacgttacgaccgtaaacgggttcgggaaccgtaacgggttaaccccgttggttaccgtaacgtccggtcctaccgcgaccgtcccttaaccgaacccggg

SEQ ID NO: 301992 - DNA, 578 bp, Homo sapiens
  misc_feature: GZ8MTXP01EN2VA.11.40.D07.1.454.CMB.2.raw
  modified_base (276)..(276): a, c, t, g, unknown or other
  misc_feature (276)..(276): n is a, c, g, or t
  modified_base (508)..(508): a, c, t, g, unknown or other
  misc_feature (508)..(508): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcactgggtccgccaggctccgaggcaagggactggagtggctatcatttangtcatttgatggaactaatatatactattcgtgggggaccttaagggtcgatttcacctatctaccagagaccaattccgaaggaacacggctgtaatctagactaaattacacacgaccccgaacaactggaaccgactaccgggtctttagttttacttaacctggtcacccaagagtaactagtacgtacgtaaatttaggcgtaggggtcgacctaagtcagtcatanaattgacctaacgttcgggaccagggaacccttggttcaagtctcctccgtcacgtcccttccgaacccg

SEQ ID NO: 301993 - DNA, 588 bp, Homo sapiens
  misc_feature: GZ8MTXP01BXQSB.11.40.D07.1.454.CMB.2.raw
  modified_base (235)..(235): a, c, t, g, unknown or other
  misc_feature (235)..(235): n is a, c, g, or t
  modified_base (333)..(333): a, c, t, g, unknown or other
  misc_feature (333)..(333): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccncaggctccgaggcaaggggactggagtggctatcattatgtcatttgatgaactaatatatactatcgtggggccttagggtcattcacatctcaganacaatcagaacacgctgtaatctgactaaattacaacgacgaccccgaacaactcgaacgacacggtcttaggtttaacttacgtgtcgaccaacagtaatacgtacgtacgtaaatttaggcgtagggggtcgacctaaggtaaccaggttaccaattaccgtaatttcgaccgtaaacggttcggggacccaacgggttaaccccttgggttacaacgtccgtaactcctcgaccgtcccttcccgaaacccg

SEQ ID NO: 301994 - DNA, 636 bp, Homo sapiens
  misc_feature: GZ8MTXP01AOMK8.11.40.D07.1.454.CMB.2.raw
  modified_base (412)..(412): a, c, t, g, unknown or other
  misc_feature (412)..(412): n is a, c, g, or t
  modified_base (465)..(465): a, c, t, g, unknown or other
  misc_feature (465)..(465): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtccgccaggctccgaggcaaggggactggagtggctatcatttatgtctatttgatgaactaatatatactattcgtaggggtaccgttaagggtcgtatttcacctatcctaccagacgaacctaattccgaaggaaccacgtctagtctctagactaaattaccacacgaccccganaaactgaaccgactaaccggtctttagtttaacttacgtggtacgaccctaanaagtaacttaacgggtaacgtacggttaaaagtttcgggacgtagggggtcgaccgtaagttaccagtactaatacgtaatttcggaccctaaaggttcggggacccaaggggttacccgttggttaccaattccgtcctccctcgaccgtcccgttaacccgaaacccgg

SEQ ID NO: 301995 - DNA, 617 bp, Homo sapiens
  misc_feature: GZ8MTXP01DMOT8.11.40.D07.1.454.CMB.2.raw
  modified_base (582)..(582): a, c, t, g, unknown or other
  misc_feature (582)..(582): n is a, c, g, or t
tcagcgagagataccacgaccggtgctcgatttagtgatagagcgtaaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtcccgccaggcctccgaggacgaaggggactggagtggctatcatttatgttctatttgataggaaacttaatattatacttagttcgtgggggtacgttaagggtctatttaccacctatctcagacaaccaattccgaagaacacgtctagtaatctagactaataccacacgacccgacaactacgacgacgacgtacttagtttacttacgtgtcgaccaacagtaactagtaacgtagttaaactttaggacgtagggggtcgaccgaaggtactaacgtactaactactaagtttcgaccgtaacggttcggggaccgaacggttaacccgttggttacctntccgtcctcctcacgtccccttaaccgaaccccgg

SEQ ID NO: 301996 - DNA, 628 bp, Homo sapiens
  misc_feature: GZ8MTXP01ERXBH.11.40.D07.1.454.CMB.2.raw
  modified_base (236)..(236): a, c, t, g, unknown or other
  misc_feature (236)..(236): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcactgggtccncaggctccgaggcaagggctggagtggctatcatttatgtcatttgatggaactaatatatactattcgtggggtacgttaagggtcatttccacatctaccagagacaattcgaggaacacgactgtaatctgactaattaacacgtacgacccgaacaacgtcgaaccgactaccggtcttagttttactttaacgtgttacgacccaactaacgaattaacgtacggtaacgttaaacgtttacggaccggtaagggggtcgtaccgtaagtaccgtagtacattaacaattttcgacgtaacggcggggaccgaacggggaacccttgggttacctaagtccggttaacccttcccgtacaccggtccccttaacccgaaaccccggg

SEQ ID NO: 301997 - DNA, 620 bp, Homo sapiens
  misc_feature: GZ8MTXP01AVIUB.11.40.D07.1.454.CMB.2.raw
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccgccaggctaccgaggcaaggggctggagtggctatcatttatgtcatttgatagaactaatatatactattcgtgggtcgttaaggtcatttcaccatctacagactaccaacttcgaggaacacggactgtaactcagactaaattaccacacgtaccccgacaaactcggaacgtaccgacggtcttagttttactacgtacgtcgccaacagtaactagtaacgtacgtaaagtttacggacggtacgggggtcgaccgacgttacgtacgtactaactactaactttcggaccctaacgggttcggggacccgtaacggggttaaccccgttgggttaccaagtccgttaacctccctacgccgtaacccttccgaacccgg

SEQ ID NO: 301998 - DNA, 779 bp, Homo sapiens
  misc_feature: GZ8MTXP01BX8P4.11.40.D07.1.454.CMB.2.raw
  modified_base (239)..(239): a, c, t, g, unknown or other
  misc_feature (239)..(239): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagccgtgggaggtccctgagactctcctgtgcagcctctggattcatcttcaattacctttggcatgcacgtgggtcccnccaggcctccgaggcaaaggggactgggagtggacttatcatttagtgttctagtttagaataggtaaacttaattagtaattacttaagtttcggtacgggggtaccgtttaaggggtcctatttaccacctattcctacgaagaacgaaccctaaacttaccgaagggaaccaccgtacttagtaactcctagtaacctaaacttaccaacacggaaccccgaacaacgtacgaaccgaacgtaccggtctttaaggtttaattaccgtagtacgaaccaacgtaagtaacttaacgtaaacggtacggttaaagtttaccggacgggtaacgggggttccgaacccgtaaaggttaaccgtaaggttactaaacgtttaaaccaagtttttaccgggaaacccgtaacccgggtttacgggggaaccccggttaaaccggggttaaccccgttggggtttacccaaccggtttcccggttaaccccgtttccccaacggttaccccgtaaccccgttcccccgggtaaaaccccggg

SEQ ID NO: 301999 - DNA, 705 bp, Homo sapiens
  misc_feature: GZ8MTXP01CLA15.11.40.D07.1.454.CMB.2.raw
  modified_base (244)..(244): a, c, t, g, unknown or other
  misc_feature (244)..(244): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagccgtgggaggtccctgagactctcctgtgcagcctctggattcattcttactaattacctttggcatgctacgtcgggtcccnccaggcctccgaggcgaaggggctggagtggctatcatttatgtctagtttgatggtaaattaagtattatactattcggtagggggtaccgtttaagggtcgtacttccgactactcctacagaacgtaacctacttaccgaaggtaaccacgtccttagttaactcgtaacgactaaactaccaacgtacgacccgaactaacgtacggacgacgtacggtacttacgtttacttacgtacgtcgaccaacgtaagtactaacgtaacggtacgttaaagtttaacggcggtaacggggtcgtacccgtaaagtacgtacggttactaacgttaacttaacgtttacggaaacccgtaacgggttaccgggggtaaccctacggggttaaacccgttggttaccgtaaccggttcctcccgtaccctacgacccgtcccgttaacccgtaaaccccggg

SEQ ID NO: 302000 - DNA, 632 bp, Homo sapiens
  misc_feature: GZ8MTXP01BCISU.11.40.D07.1.454.CMB.2.raw
  modified_base (238)..(238): a, c, t, g, unknown or other
  misc_feature (238)..(238): n is a, c, g, or t
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtcgggtccnccaggcctccgaggacgaaggggactgggagtggctatctatttatgtntatttgataggaacttaatattatacttagtttcggtagggggtaccgtttaagggtcgtacttcaacctagtacctaccaaggacaaccctaactaccgaaggaacncgcttagtntctagacaacttaccacacgaccccgaacactacgacgactcggtctttagtttactacgtgtcacaacagtactaagtaccgtagtaagttacgcggagggtcgaccgtagtacgtagtactaatctaacttcgaaccgttaacggttccggggaaccgtacgggttaacccgttcgggaccttaacgtcctaaccgtcctcgttacccgtccttcccgaaacccgg

SEQ ID NO: 302001 - DNA, 591 bp, Homo sapiens
  misc_feature: GZ8MTXP01DLTOL.11.40.D07.1.454.CMB.2.raw
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaaggggactgggagtggctatcatttatgtcatttgatggaactaatatatactattcgtggggccgttaagggtcgatttcaccatctccagagacaattcaggaacacgctgtaatctgactaaataccacacgacccgacaactcgacgacaacggtctagttttattactgtgccacaagatacgtacgacgtaaagtttagcgtaggggtcggccgaagttaccaagttccaattactaatttcgcctaaacgttcggggacccgtaacggggaaccccgttgggttacctaagttccgtcccgtccctccgttaacgccccttaacccgaaaccccgg

SEQ ID NO: 302002 - DNA, 724 bp, Homo sapiens
  misc_feature: GZ8MTXP01D4OHE.11.40.D07.1.454.CMB.2.raw
  modified_base (245)..(245): a, c, t, g, unknown or other
  misc_feature (245)..(245): n is a, c, g, or t
  modified_base (463)..(463): a, c, t, g, unknown or other
  misc_feature (463)..(463): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtggggggaggcgtggtccagccgtgggaggtccctgagactctcctgtgcagcctctggattcattcttacaattacctttggctatcgcacgtcgggtcccnccgaggcctccgaggcgaagggtctggagtggctatctatttagtgttactatttgaataggtaaacttaattaatattacttagttcggtacgggggtacgtttaagggtcgtacttaccgacctattcctaccgaagaacgtaacctaaacgttaccgaaaggtaaccacgtactagttaactctagacctaaacttaccaacgacgacccctaanacgtacgaacgtacgcggttactttagtttactacgtgtacgaccctaagtaacgtaacttaacgggtaacgtaaggtttaaagtttacgggaccggtaaggggtccgaacgtaacggtactaggtaactaacgttaactaacgtttccggaaaccgtaacggggttaccggaacccgggtaacggttaaccccgttgggttaaccctaacgttccggtcccttcccgacgacccgtccccgttaacccgtaaaccccggg

SEQ ID NO: 302003 - DNA, 657 bp, Homo sapiens
  misc_feature: GZ8MTXP01EOPOZ.11.40.D07.1.454.CMB.2.raw
  modified_base (296)..(296): a, c, t, g, unknown or other
  misc_feature (296)..(296): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagccgtgggagtccctgagactctcctgtgcagcctcgtggtattcattcttacaattacctttggctatgctaccgtcgggtccgccgaggcctaccgaggacgaaggggactggaggtgctatctatttatgttntatttgatagtaacttaatatatactagttcggtagggggtaccgttaaggtctacttcacctattccacgaagacgaactaactacgaagaacctcgtacttagtaactctacgactaaacttaccaacgtaccgacccctaacgaacgtacggaaccgtacgtacggttatttacgttttaacgttaactcgggtaccactaacgtaagtacttacgggtaacggtacgttaaagtttacggacgggtaggggtcgaccgttaaggtactagtacctagtactaagttcgaccgtaacggttcgggactaacgggttaccttggttactgtcctctcctcgactcccgaacgaacccgg

SEQ ID NO: 302004 - DNA, 602 bp, Homo sapiens
  misc_feature: GZ8MTXP02GLFO1.11.40.D07.1.454.CMB.2.raw
  modified_base (235)..(235): a, c, t, g, unknown or other
  misc_feature (235)..(235): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccnccaggctccaggcaaggggactggagtggctatcatttatgtcatttgatggaaactaatatatactattcgtggggaccgtttaagggtctattcacctatctccaagagaccaattccaaggaaccacgctagtatctgactaaattacacacgcccgaacaactagacgacacggtcttagtttacttactgtcgaccaacagaataatacgacgtaaatttacggcgaagggggtcgactaagtacagtaccaattactatttacgaccctaaacggtcgggggacccaacggggtaaacccccttggggtacctaacgttccgtaccttccctacgaaccggtccccttacccgaaacccgg

SEQ ID NO: 302005 - DNA, 596 bp, Homo sapiens
  misc_feature: GZ8MTXP02I5CT5.11.40.D07.1.454.CMB.2.raw
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (449)..(449): a, c, t, g, unknown or other
  misc_feature (449)..(449): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccncaggctccaggcaagggctggagtggctatcatttangtcatttgatggaactaatatatactattcgtggggtacctttaaaggggtctatttcacctatcctccaagacgaacctaacttccgaaggaaacacgcttagtactctagactaaattacaacacgacccgaacaaactgaaccgacacggtcttagtttatacgtgtacgaccanagaattactaccggtagtaaagtttaggacgtagggggtcgaccaagttacagtacatactatttcggaccctaaacgtcgggggaccaacggggtaacccttgggtacaacgttccgtcctcctacgacctccctaccgaacccgg

SEQ ID NO: 302006 - DNA, 652 bp, Homo sapiens
  misc_feature: GZ8MTXP02JQT6S.11.40.D07.1.454.CMB.2.raw
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggagtccctgagactctcctgtgcagcctctggattcatcttcaattacctttggcatgcactgggtccnccaggctccaggcaaggggactggagtggctatcatttangtctatttgatggaaactaatatattactattcgtggggaccgtttaaaggggtctaatttccaacctattcctaccaaaggtacgaacccctaaattcccgaaagggtaaaccacggtcttaggtactccgttagacctaaaattaccaaccgaacgacccccgaaactaaaccgtcggaaaccgaccgaacgggtcctttagttttaacttacgtgtacgacccaagtaagtattagtacccgagtaaatttagggacgtaagggggtcgacctaggtacagttacaattaactatttacgacctaaacggtcggggacctaacgggggaccctgggtccaagtcccgtactcccgtcacgtcccctacgaacccg

SEQ ID NO: 302007 - DNA, 752 bp, Homo sapiens
  misc_feature: GZ8MTXP02F5ETX.11.40.D07.1.454.CMB.2.raw
  modified_base (275)..(275): a, c, t, g, unknown or other
  misc_feature (275)..(275): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccgccaggctccgaggcaaggggctggagtggctatcatttangtcatttgatgaactatatatactattcgtggggtaccgtttaagggtctattccacctattcctaccaaggacgtaaccctaaactttccccgaaagggtaaaccacggtaccttaggttactccgttaggacctaaaactttacccaacgtaaccggacccccgaaactaaaccgttacggaaacccgaaccgtaccggggtactttacggttttaaactttaaccgttcgggttacgaccccctaacgtaaaggtaaacttaaagtaacccggtaccgttaaaagtttttacgggacggtaacgggggttcggacccgtaaggttaacccgagttacaaacgttaacctaagttttacggacccgtaaacgggttacgggggaccccgtaacgggggtaaaccccctggggtaacctaacgttcccggttacccttacccgtaccgaccggtaccccttaccccgaaaccccgg

SEQ ID NO: 302008 - DNA, 581 bp, Homo sapiens
  misc_feature: GZ8MTXP02HUW0Z.11.40.D07.1.454.CMB.2.raw
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccnccaggctccaggcaagggctggagtggctatctatttangtctatttgatggaactaatatatactattcgtggggaccgttaagggtctattcaccatctaccagacgaccaattccagaacncgctagtatctagactaattaccacacgacccgaacaaactgaacgacacggtcttagtttacttactgtcgaccanagtatatacgataattagcgtaggggtcgacgtagtactagtacacttaactatttacgacctaaacgttcgggggacccaacggggtaaccccttggtaccaacgttccgtacctaccctcgaaccgcccttacccgaaacccgg

SEQ ID NO: 302009 - DNA, 626 bp, Homo sapiens
  misc_feature: GZ8MTXP02JT8DS.11.40.D07.1.454.CMB.2.raw
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaatacctttggcatgcactgggtccnccaggctccgaggcaaggggactggagtggctatctatttatgtctatttgatgaactaatatatactatcgtggggaccgttaaggtcattcacatcncagagaccaatccaagaacacgcttagtatcgtanacctaaattaccacacgcccgaanaactcggaacacgacggtcttagtttaactactgtcgaccctaagaaagtaattaacgtacggtaaccgttaaagtttacgggacgtaagggggtacgaccctaagggtaaccagttacaaagttaccctagtttaccgaccgtaaacggtcgggggaaccctaacggggaaccccttgggtaccaaggttccctacccgtctacccgtaacgccccgttacccgaaacccgg

SEQ ID NO: 302010 - DNA, 548 bp, Homo sapiens
  misc_feature: GZ8MTXP02HFJOJ.11.40.D07.1.454.CMB.2.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (415)..(415): a, c, t, g, unknown or other
  misc_feature (415)..(415): n is a, c, g, or t
  modified_base (529)..(529): a, c, t, g, unknown or other
  misc_feature (529)..(529): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaattacctttggcatgcactgggtccnccaggcctccaggcaaggggctggagtggctatcatttangtcatttgatgaactatatatactatcgtgggcttaaggcattcacatcncaganacatccagacacgctgtatctgactaattacacacgacccgaacaactcgacacgacggcttagtttactacgtgtacgcccaanagtataactacggtactaaatttacgcgaaggggtcgacctagtacagtacatactatttcgacctaaacgtggggaccacggggaacccctggaccaagtccgtactccctanaccgtccctaccaacccgg

SEQ ID NO: 302011 - DNA, 613 bp, Homo sapiens
  misc_feature: GZ8MTXP02JTNIR.11.40.D07.1.454.CMB.2.raw
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcattcttcaattacctttggcatgcacgtgggtccgccaggcctccgaggcgaaggggacgtggagtggctatctatttatgtntattgataggtaaactaatatatactattcgtggggtacgttagggtctattcactatcncaganacctatccagaacncgctntatctgactaatacacacgacccgaacaacgacgaccgacgacggtcttagtttactacgttgtacgaccaactaagtactaacgtacggtacgtaaagtttacgggacggtaggggtcgaccgtaaggtactagtacaagttactacgtttacgaccgtaacggtacggggacccgtaacggggaacccgttggtacaacgttccgttcctaccgtccgaaccgtccctaaccgaaccccgg

SEQ ID NO: 302012 - DNA, 635 bp, Homo sapiens
  misc_feature: GZ8MTXP02GMXA8.11.40.D07.1.454.CMB.2.raw
  modified_base (282)..(282): a, c, t, g, unknown or other
  misc_feature (282)..(282): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtccgccaggcctccgaggacgaaggggactggagtggctatctatttangtctatttgatagaataatatatactatcgtggggtccgttaaggctattcacctatctcaganacctaatccagaacacgntgtatctagactaaacttacaacgacgtacccccgaaanaaactacggaaccgacgtacgggtcctttagttttaacgttactcgtacgaccctaagaagtaattaacgtaacggtacgttaaaagtttagggaccggtaagggggtacgacctaaaggtaacctagtactaaagtactactttacggaccctaacggtcggggaaccgacgggtaacccgtggtacctaacgtccgtaccttcccgtcgaacgccccttaccgaaacccg

SEQ ID NO: 302013 - DNA, 625 bp, Homo sapiens
  misc_feature: GZ8MTXP02JXF1U.11.40.D07.1.454.CMB.2.raw
  modified_base (235)..(235): a, c, t, g, unknown or other
  misc_feature (235)..(235): n is a, c, g, or t
  modified_base (344)..(344): a, c, t, g, unknown or other
  misc_feature (344)..(344): n is a, c, g, or t
  modified_base (447)..(447): a, c, t, g, unknown or other
  misc_feature (447)..(447): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcacgtgggtccncaggctccaggcaaggggactggagtggctatctatttatgtcatttgatggaactaatatatactattcgtggggtaccgttaagggtcattccacctatctccaganaccaatccgaaggaacacgctagtactctacgactaaattaccaacacgaccccgaaacaactcgaaccgtacgacggtcttagtttacttactggtcaccanacgataataccgagtaatttagggacgtaaggggtcgacctaaggtaacctagtacctaataactacgtttacgacccgtaaacgggtcgggggaacccgaacggggtaacccccgtgggtacctaacgtcccggttacctcccgtaccgacccggtaccctacccgaaaaccccggg

SEQ ID NO: 302014 - DNA, 605 bp, Homo sapiens
  misc_feature: GZ8MTXP02J02WS.11.40.D07.1.454.CMB.2.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcacgtgggtccnccaggctccaggcaaggggactgggagtggctatcatttangtcatttgataggaactaatatatactattcgnggggtaccgttaagggtcattcaccatctcaganaccatccaggaacncgctgtnctnacaattcacacgcccacaacngacacgacggcttagtttactactgtcgcctaacagactagtaccgagtaaatttacggcgaagggggttcgaccgtaaggtaaccaggtactaaattaacctagtttacgaccccgtaaaacggtcgggggacccgaacggggtaacccccttggggttaccctaagttcccggtaccctacccgttccaccggtcccccttacccgaaacccggg

SEQ ID NO: 302015 - DNA, 608 bp, Homo sapiens
  misc_feature: GZ8MTXP02JMZ0V.11.40.D07.1.454.CMB.2.raw
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtcccgccaggcctccgaggcgaaggggactggagtggctatctatttatgtcatttgatagaaactaatatatactatcgtagggccgttaaggtcattcactatcctccaagacaccaattaccaaggaacacgctagtntctgactaaatacactacgaccctaanacgtgacgactacggtcttagtttactagtgtcaccaanacgattaaacgtacgtaacgtaaatttcgggacgtaggggtcgacgtaagtacacgtanaacgtactacgttcgaccgtaaacggtcggggaacccgtacggggaaccccgttggtacctaacgtcccgttacctaccgtacgaaccgtccccgtaccgaaaccccgg

SEQ ID NO: 302016 - DNA, 618 bp, Homo sapiens
  misc_feature: GZ8MTXP02GVNN0.11.40.D07.1.454.CMB.2.raw
  modified_base (239)..(239): a, c, t, g, unknown or other
  misc_feature (239)..(239): n is a, c, g, or t
  modified_base (359)..(359): a, c, t, g, unknown or other
  misc_feature (359)..(359): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgctacgtgggtcccncaggcctaccgaggcaaggggctggagtggctatctaatttatgttctatttgataggaaacttaatatattactattcgtggggtaccgttaagggtctattcaccattcctccaaganaaccctaattccgaaggaaccacgtcttagtactctagactaaattaccaacgtacgaccccgaacaacgtacgacgaccgtacggtcttagtttaacttcgtgtacgaccactaagtaacttaataccgtagtaaagtttagacggtaggggtcgacctaaggtacagtactatactattcgaccgtaacggtcgggaccgacggtaccctggtacctaagttcccgtccttccaccgactcccctacccgaacccgg

SEQ ID NO: 302017 - DNA, 588 bp, Homo sapiens
  misc_feature: GZ8MTXP02FP7DS.11.40.D07.1.454.CMB.2.raw
  modified_base (235)..(235): a, c, t, g, unknown or other
  misc_feature (235)..(235): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaattacctttggcatgcactgggtccncaggctccaggcaagggctggagtggctatctatttatgtctatttgatggaaactaatatatactattcgtggggtcctttaagggtcattcaccattctaccaagacgaacctaaacttcccgaaggtaaccacggtcttagttacnctagactaaattaccaacacgaccccgaaanaactacgaaccgaactacggtcttagtttacttactgtcgacccatacgataactacgagttaaatttcggacgtaggggtcgaccagtacagtactatactattcgaccaacggtcggggaccacgggtaccctggtaccaagttccgtctcctacacgccctaccaaccgg

SEQ ID NO: 302018 - DNA, 604 bp, Homo sapiens
  misc_feature: GZ8MTXP02HEV90.11.40.D07.1.454.CMB.2.raw
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (402)..(402): a, c, t, g, unknown or other
  misc_feature (402)..(402): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtccnccaggctccaggcaaggggactggagtggctatcatttangtctatttgatgaaactaatatatactattcgtaggggtaccgttaagggtcgattccaacctatcctaccagtagaaccctaattccgaaggaaccacgcttgtatctagactaattaccaacncgacccgacaactgacacgacggcttagtttatacgtgtcgacacagatagtacgtacgtaaagtttaggacgtagggtcgacgtacgtacagtacactaactacgtttacgacctaaacggttccgggggaccgtaacgggaaccccgttgggtacctaacgttccgtaccttcccgtacaccgtacccaccgaaaccccg

SEQ ID NO: 302019 - DNA, 592 bp, Homo sapiens
  misc_feature: GZ8MTXP02F1GMG.11.40.D07.1.454.CMB.2.raw
  modified_base (242)..(242): a, c, t, g, unknown or other
  misc_feature (242)..(242): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagccttctggattcattcttacaattacctttggccatgcacgtcgggtccnccaggcctcaggcaagggctggagtggctatctatttatgtcatttgatgaactatatatactatcggtgggtacgttaggtcattcactatcacaganaccacgtcaggtaacacgntgtatcngacaattacacacgtcccgaanaacgtgacgacgtacgtcttagttacttactgtacgactaacgagtaatacgtacgtagtaaagtttacggacgtaggggtacgtacgtagttaacagtacacgttactagtttacgacgtaacggtacgggaccgtaacggaacccgtggtacctaacgttaccggtctaccctcgaaccgtacccgtacctaaaccccggg

SEQ ID NO: 302020 - DNA, 754 bp, Homo sapiens
  misc_feature: GZ8MTXP02HB1Z4.11.40.D07.1.454.CMB.2.raw
  modified_base (237)..(237): a, c, t, g, unknown or other
  misc_feature (237)..(237): n is a, c, g, or t
  modified_base (276)..(276): a, c, t, g, unknown or other
  misc_feature (276)..(276): n is a, c, g, or t
  modified_base (379)..(379): a, c, t, g, unknown or other
  misc_feature (379)..(379): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgcacgtgggtccncaggctccgaggcaagggctggagtggctatctatttangtctatttgatgaaactaatatatactattcgtggggtacctttaaagggtctaattccacctatcctaccaagtacgaaccctaaattcccgaaggaaaccncggtccttagttactctacggaactaaatttaaccaacgacgaccccccgaaaactaacgttacggaaacccgtaaccgtaaccgggtcttttaacggtttttaaacttacccgttagggttaccgaacccctaaaccgaaaggttaacctttaaagttaaaccccggtaacggtttaaaacgtttttaaaggggcccgggttaaaggggggttcccggaaacccctaaagggttaaaccctaaggttaccctaaaagttaacccttaaagttttaccggaacccggtaaaacggttcgggggaacccctaaacgggggtaacccctggttacaacgttccgtacctccgtacaccggtccctaaccgaaaccgg

SEQ ID NO: 302021 - DNA, 701 bp, Homo sapiens
  misc_feature: GZ8MTXP02JKF7L.11.40.D07.1.454.CMB.2.raw
  modified_base (238)..(238): a, c, t, g, unknown or other
  misc_feature (238)..(238): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagcctggggaggtccctgagactctcctgtgcagcctctggattcattcttcaattacctttggcatgcacgtgggccnccaggctccgaggaccaaggggactgggagtggactatctatttatgtactatttgagtgaaattaatatattacttagttcggtggggtaccgttaagggtcgtacttaccactactcgtaccgagaacgtaacctaacttccgaaaacggtaacaccggtacttacgtactctacggaacctaaacttaaccacgaaccgacccgaaaccaaacgtagaaccgacgaccggtcttagtttacttaacgtcgtagacccagtaaagtacttaacgacggtacgttaaagtttacggacgggtaacggggtcggaccgtagttaacgacgttaccgtaaaattaacgtacgtttacggaaaccgtaaccgggtacggggtaaccccggtacggggtaaacccgttggtaccgtaacgttcccggtacctcccgttacgaccggttacccacccgtaaacccgg

SEQ ID NO: 302022 - DNA, 642 bp, Homo sapiens
  misc_feature: GZ8MTXP02IAFFL.11.40.D07.1.454.CMB.2.raw
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (478)..(478): a, c, t, g, unknown or other
  misc_feature (478)..(478): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtcgtgggggaggcgtggtccagccgtgggaggtccctgagactctcctgtgcagcctctggattcattcttacaattacctttggctatgctacgtcgggtccgccgaggctcgaggcgaaggggctggagtggctatctattatgtactagttgatagtaataatatatactagttcgtggggtaccgttaagggctattcactatctaccgagacgaaccctaacgtaccgaaggaacncgtcttagtntcgtagactaaattaccactaacgccccgaaataacgtgaaccgaacgtacggtctttaggtttaacttacgtgtaccgaccctaaanagtaatacgtaacggtaattaaagtttacgggccggtaagggggtccactaacggtacacgtactaataacttgttacgaccgtaaacggtcggggaacctacgggtacctggtacctaacgtcccgtaccttcccgacgtacccgtaccctaaccgaacccgg

SEQ ID NO: 302023 - DNA, 654 bp, Homo sapiens
  misc_feature: GZ8MTXP02I5UZG.11.40.D07.1.454.CMB.2.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
  modified_base (517)..(517): a, c, t, g, unknown or other
  misc_feature (517)..(517): n is a, c, g, or t
tcagcgagagataccacgaccggtgctcgatttagtgatagagcgtaacaacagaggactcaccatggagtttgggctgacctgggttttcctcgttgctcttttaagaggtgtccagtgtcaggtgcagctggtggagtctggggggaggcgtggtccagcctgggagtccctgagactctcctgtgcagcctctggattcattcttacaattacctttggcatgcacgtgggtcccgccaggcctccgaggcgaaggggactgggagtggctatctatttatgtctatttgagtagaactaatatatactagttcgtggggtaccgttagggtctattcacctatcgtacaagactaacccaactaccgaagaaccacgcttagtctctagacctaaataccacgacgacccaanaaaccgtggaaccacgacggtnttagttttactgtgtaccacctaaanagaaattacggacgtacgttaattacgggacgtagggtccgaataggtaacntacgtacgtacttacggtttacgaccgtaaacggggtcggggtaacccgaaccggggttacccgttcggtactaaccgtttaccccgtacttacccccgtacccgacggtccccccgttaaaccgaaacccccgggg

SEQ ID NO: 302024 - DNA, 324 bp, Homo sapiens
  misc_feature: GZ8MTXP02IGSGA.17.2.A02.1.454.CMB.2.raw
  modified_base (321)..(324): a, c, t, g, unknown or other
  misc_feature (321)..(324): n is a, c, g, or t
tcagcgtagactagcacgaccggtgctcgatttagactcatctacagggaaagccctaaactcctgatctataaggcatccagtttagaagtgggtcccatcaaggttcagcggcagtggatctgggacagaattcactctcaccatcagcagcctgcagcctgatgatcttgcaacttattactgtcaacagtataatttttatccttggacgttcggccaagggaccaaggtggaaatcaaacgactgtggctgcacatctgtcttcatcttcccgcatctgactagtctacgctgagcgggctggcaaggcgcatagnnnn

SEQ ID NO: 302025 - DNA, 330 bp, Homo sapiens
  misc_feature: GZ8MTXP02HOHI3.17.2.A02.1.454.CMB.2.raw
  modified_base (326)..(330): a, c, t, g, unknown or other
  misc_feature (326)..(330): n is a, c, g, or t
tcagcgtagactagcacgaccggtgctcgatttagactcatctacagggaaagcccctaaactcctgatctataaggcatccagtttagaaagtgggtcccatcaaggttcagcggcagtggatctgggacagaattcactctcaccatcagcagcctgcagcctgatgatcttgcaacttattactgtcaacagtataatttttatccttggacgttcggccaagggaccaaggtggaaatcaaacgaactgtggctgcaccatctgtcttcactcttcccgccatctgactagtctacgctgagcggctggcaaggcgcatagnnnnn

SEQ ID NO: 302026 - DNA, 606 bp, Homo sapiens
  misc_feature: GZ8MTXP01BELK7.52.78.H01.1.454.CMB.2.raw
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtacagcagaggccaggccacggccccttatggtgatatataaaggaccatgagacggccctgagggactcccgtgagcgtattctcgtcggcctcctctcagggaacaacnggtcacggttanatacatcgaggtggacggtccgggagaaggacggacggaggtctagtaacttagttacgtagtaactaataacgaaacgtaacggaactaaggttaagttaggttaacttagtagtagtacgtacgggtcgggacgggaacgggaaccgaaggtccgttacggtaacccggtcgttaacggttccgacggaacccgacggtccgtcccggccccgttcggtaaccttccgtccg

SEQ ID NO: 302027 - DNA, 510 bp, Homo sapiens
  misc_feature: GZ8MTXP01EGRWF.52.78.H01.1.454.CMB.2.raw
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (431)..(431): a, c, t, g, unknown or other
  misc_feature (431)..(431): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaaagcaatatggttatggtacagcagagcagcagccctatgnatanataagacatgagaggcctcagggatccctgagcgattcctctggctcctcctcagggcaaacagtcacgttgatcatcagtggagtcgggcagaggacgaggctgactattactgtcaatacaacagaacagtagtagtatatgtgcgngtcggcggagggacgaacgacgtcgaccgttccgttacgtcgacgaaccgaacggacgttccgtccccgttcccgtccg

SEQ ID NO: 302028 - DNA, 628 bp, Homo sapiens
  misc_feature: GZ8MTXP01CN559.52.78.H01.1.454.CMB.2.raw
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggttatggtacagcagngcagcaggcccctatggnatatataagacatgagaggcctnaggatcccgngagctatctcgtccgcctctctacgacggaaacaacgcgtactacgttagactacacgtacgaggtacgggtacggtaccgggacgagggaacgggaacggtacggtacgtacgtaacgttaacgttacgtacgtaactaaactacgaaacgtaagtaacgtaaggttaaggttagttaacgttagtacgtcgtacgtacgggttacgggacgggtaacggtaaccgaggtcgttacggtaacccggttcgttacggttccgaccggtaacccgaacggtccgtcccggtccccgttaccggtccgttaacccgttccg

SEQ ID NO: 302029 - DNA, 505 bp, Homo sapiens
  misc_feature: GZ8MTXP01EHAFH.52.78.H01.1.454.CMB.2.raw
  modified_base (429)..(429): a, c, t, g, unknown or other
  misc_feature (429)..(429): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccccttatggtgatatataaggaccatgagaggccctcagggatccctgagcgattctctgggctccctcctcagggacaacagtcacgttgatcatcagtggagtccggcagaggacggaggctgactatactgtnaatcaacagacagtaagtgttattattgtagcagttcggcgggaagggacaagctaggaccgtccgttggtaaccg

SEQ ID NO: 302030 - DNA, 482 bp, Homo sapiens
  misc_feature: GZ8MTXP01BSFN5.52.78.H01.1.454.CMB.2.raw
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
  modified_base (430)..(430): a, c, t, g, unknown or other
  misc_feature (430)..(430): n is a, c, g, or t
  modified_base (478)..(478): a, c, t, g, unknown or other
  misc_feature (478)..(478): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttatgtacagcagagcagcagccctatgngntatataaggacatgagaggcctcagggatccctgagcgattctctcggctctcctcaggaacaacngtcacgttgatcatcagtgagtccgggnagaggacgaggctgactatactgtcaatcaacagacagtagtggtacttatgtgcagttcggnggaaggaccagcttgaccgtcaggttcagcccaagctgccccttgtcncgtc

SEQ ID NO: 302031 - DNA, 484 bp, Homo sapiens
  misc_feature: GZ8MTXP01C9T3C.52.78.H01.1.454.CMB.2.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
tcagcgcagtacgacacgaccggtgctcgatttagtgtgagtagtttgggtttggggtgggtccaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctntggagatgcactgaccaaagcaatatggttatggtaccagcagaggcaggccaggcccctatggtgatatataaggaccatgagaggcctnagggatcccngagcgatctctcggctctctcgaggaacaacngtcacgttgatcatcagtgagtccgggnagngacgaggctgactatactgtacaatacgaacaagacagtagtggtatatgtgcagtcgngnggacagcttgactcttagcagcccagctcncccngtcnctcc

SEQ ID NO: 302032 - DNA, 503 bp, Homo sapiens
  misc_feature: GZ8MTXP01A9403.52.78.H01.1.454.CMB.2.raw
tcagcgcagtacgacacgaccggtgctcgatttagtgtgagtagtttgggtttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggtatcacctgctctggagatgcactgccaaagcaatatggttattggtaccagcagaggccaggccaggcccccttatggtgatatataaggaccatgagaggccctcagggatccctgagcgattcctctggctcctcctcagggcaacagtcacgttgatcatcagtggagtcgggcagaggacgaggctgactatactgtcaatcaacagacagtagtggtacttatgtgcaggttcggcggagggaccaggctgaccgttcttaggtcagcccaagccttcgccccttggtcc

SEQ ID NO: 302033 - DNA, 511 bp, Homo sapiens
  misc_feature: GZ8MTXP01CAOV9.52.78.H01.1.454.CMB.2.raw
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggcccccttatggtgatatataaggaccatgagacggccctgagggactccctgagcgattccctctggctccctcctacgagggaacaacaggtcacgttgatcatcagtggagtccgggnaggaggcgagctgactagtactgtcaatcaacagacagtagtgtacttntgtngnggttcggnggaggaccagctgaccgttnttacggtcngccagccttcgccccgttgtccc

SEQ ID NO: 302034 - DNA, 500 bp, Homo sapiens
  misc_feature: GZ8MTXP01EJ6XP.52.78.H01.1.454.CMB.2.raw
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaaagcaatatggttattggtaccagcagaggccaggccaggcccctatggtgatatataaaggaccatgagaggccctcagggatccctgagcgattctctcggctctctcaggaacaacngtcacgttgatcatcagtgagtccggnagagacgaggctgactatactgtacaatcgaaacagacagtagtggtattatagtncagttcggnggaaggaccaagcttgacgtcagttcacgcccagctcgcccttcggcttctccg

SEQ ID NO: 302035 - DNA, 507 bp, Homo sapiens
  misc_feature: GZ8MTXP01D0POG.52.78.H01.1.454.CMB.2.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (450)..(450): a, c, t, g, unknown or other
  misc_feature (450)..(450): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccaggccccctatggtgatatataaggaccatgagagccctnagggatccctgagcgattcnctcggctctcctcaggaacaacngtcacgttgatcatcagtgagtccgggcagaggagaggctgactattactgtacaatcgaaacagaacagtagtggtacttagtgtgtctagttcggnggaaggaccaagcttgaccgtcttaggttcagcccaggctcgcccncgtcncgtccg

SEQ ID NO: 302036 - DNA, 520 bp, Homo sapiens
  misc_feature: GZ8MTXP01BX7RZ.52.78.H01.1.454.CMB.2.raw
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccgccaggctccgaggggaggggctgggagtgggtgccagcgtgaagcatgatggagtgagaagaactatgcgatctgtgaagggccattcacactccagagacaaacatacaaagaactacaaatgtaatctaccaaatgagcagcctgaacntccgagaccacggccgtgttatacttgtgcgagngttgttgggatgttgtcgttgcncgaag

SEQ ID NO: 302037 - DNA, 559 bp, Homo sapiens
  misc_feature: GZ8MTXP01EDPWJ.52.78.H01.1.454.CMB.2.raw
  modified_base (256)..(256): a, c, t, g, unknown or other
  misc_feature (256)..(256): n is a, c, g, or t
  modified_base (358)..(358): a, c, t, g, unknown or other
  misc_feature (358)..(358): n is a, c, g, or t
  modified_base (550)..(550): a, c, t, g, unknown or other
  misc_feature (550)..(550): n is a, c, g, or t
tcagcgcagtacgacacgaccggtgctcgatttagtgtgagtagtttgggtttgggggtgggtcaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgccaaagcaatatggttattgtacagcagngcagcaggcccctatgtgatatataaggaccatgagacggccctcgagggactcccgtgagctagttcctcgtccggctcctccgtacgacgggaaacaacngtcctaaggttcactctaactcgaggttggacggtccgggcaggaggacggaggctagacttagttactggtacaatacgaaacgagacagtagtacggtattaagtgtagtcgtaggttcggcgggaaggtacaagtcgttacggacccgtcgaggttcgacgccgaggcctcggccccgttcggtaaccncgtttcccg

SEQ ID NO: 302038 - DNA, 530 bp, Homo sapiens
  misc_feature: GZ8MTXP01D7LCT.52.78.H01.1.454.CMB.2.raw
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattgtaccagcagagcaggccaggcccctatggtgatatataagacatgagggcctgagggatcccgtgagcggatcgtccgtaggcgtactcctacgaagggacaacgagtcagttanananatanagtgaggcgacgagagagagngtagatatatatanacgtacaanagagtagtagtagtagtatgtgtagtacggtcggtaacggacggacgacgacgtacgtacgttacgttcgttacgaacgacgaacgcgtccgttcccgtccgttcgtccg

SEQ ID NO: 302039 - DNA, 526 bp, Homo sapiens
  misc_feature: GZ8MTXP01D1LUM.52.78.H01.1.454.CMB.2.raw
  modified_base (276)..(276): a, c, t, g, unknown or other
  misc_feature (276)..(276): n is a, c, g, or t
  modified_base (433)..(433): a, c, t, g, unknown or other
  misc_feature (433)..(433): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgtattggtacagcagagcagcagccctatgngatatataagacatgagaggcctcagggatccctgagcgattcctctggctcctccctcagggcaacagtcacgttgatcatcagtggagtcggcagaggacgaggctagactattactgtcaatcaaacagacagtagtagtagttaatgtgtcgngttcggcgggaggggacccgaaaggacgtcgttaccgttccgttacggttcgacgaacccgaacggacgttcgtccccgttcccgggttcccg

SEQ ID NO: 302040 - DNA, 539 bp, Homo sapiens
  misc_feature: GZ8MTXP01DYXD1.52.78.H01.1.454.CMB.2.raw
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaatatggttattggtaccagcagaggcaggcaggcccctatgngntantaaggacatgagagcctnaggactccctgagcgattctctcggctctcctcacgggaacaacnggtcacgttgatcatcagtgagtccgggnagaggacgaggctagactattactgttacaactnaacagtaacagtagtgtactttatagttgactaggttcggnggaagggaccaaaggtcgttggaaacccgttcgaggttccgacgccccgaagggccttcggcccccgttcgggtccaaccgtttcccg

SEQ ID NO: 302041 - DNA, 550 bp, Homo sapiens
  misc_feature: GZ8MTXP01ER5FG.52.78.H01.1.454.CMB.2.raw
  modified_base (533)..(533): a, c, t, g, unknown or other
  misc_feature (533)..(533): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcaggccaggcccctatggtgatatataaggaccatgagaggccctcgagggactcctgagcgattcctctggctcctccctacgacgggaacaaacgacgtcacgttgactcaatcgaagttggagtccgggacaggagggacgaggctaggactattactgttacgaattcaaacagaactagtagtggtaattatgtgcgtaaggttcggacggaggaccgttaaagcgttacggaccgttcgttaggtcacgcccgaaggtccncgtccccgttcggtccc

SEQ ID NO: 302042 - DNA, 534 bp, Homo sapiens
  misc_feature: GZ8MTXP01EQQLW.52.78.H01.1.454.CMB.2.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
  modified_base (501)..(501): a, c, t, g, unknown or other
  misc_feature (501)..(501): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtgggtttcctgttgctatttagaaggtgtcagtgtgaggcgcagctggtggagtcgtgggggagcttggtccagccgtggggggtccctgacactctcctgtgtagcctntggattcaacctttaanagttattggatgacgttgggtccncaggctcgagggagggcgtggagtggtggccgagcgtgaganangagnggaggagaggaagaatagtgcgacgtcgtgtaggacgggacgtactacactactacagagaacaacanaacaanaacacaatatatactaacaaanagagacacgcgtacgacacgtacgacgacgacgtcgtagttatagttgtgngagttgttgttgtgtgttgtcgttcgtcgcgcg

SEQ ID NO: 302043 - DNA, 563 bp, Homo sapiens
  misc_feature: GZ8MTXP01DQQ1B.52.78.H01.1.454.CMB.2.raw
  modified_base (290)..(290): a, c, t, g, unknown or other
  misc_feature (290)..(290): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatattggttattggtaccagcagagccaggccaggcccccttatggtnatatataaggacatgagaggccctcgagggactcccgtgacgcgatttccgtcctggccctccctccctacgacgggaacaaacgacgtacacgttgatcatcagtggagtccggnagaggacgaggcngactattacngtacaatcaaacagacagtagtaggttaacttatggtgcgtgggttcggacgggacgggaccaaaggcctacggacccgttcgttacgggtcaacggcccgaaggccgttaccgtcccccgttcgggttaaccc

SEQ ID NO: 302044 - DNA, 584 bp, Homo sapiens
  misc_feature: GZ8MTXP01AIQ4T.52.78.H01.1.454.CMB.2.raw
  modified_base (405)..(405): a, c, t, g, unknown or other
  misc_feature (405)..(405): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccaacagagccaggccaggccccttatggtgatatataaggaccatgagaggccctgagggatcccgtgacgcgtattctccgtggctcctcctcgaacgggacaacagtcacgttgatcatcagtggacggtcgggcaggaggacgnggctagacttattactgtacaagtcaacgagacagtagtggtacttagtgtgacgtaggttcgggcgggtaacgggaccaaaggccgttaacggacccggtttccgttacgggttaccgaaccggacccggtaaacggccccgtaccggccccccgttcgggttaacccttaaccccgg

SEQ ID NO: 302045 - DNA, 502 bp, Homo sapiens
  misc_feature: GZ8MTXP01BPYA1.52.78.H01.1.454.CMB.2.raw
  modified_base (405)..(405): a, c, t, g, unknown or other
  misc_feature (405)..(405): n is a, c, g, or t
tcagcgcagtacgacacgaccggtgctcgatttagtgtgagtagtttgggtttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaaagcaatattgttattggtaccagcagaggcaggccaggcccctatggtgatatataaggaccatgagaggccctcagggatccctgagcgattcctctggctcctcctcagggcaacagtcacgttgatcatcagtggagtcgggcagaggacgaggctgactattacngtcaatcaacagacagtagtggtattatgtgcagttcggcggagggaccaagctgacccgttcttaggtcagcccaaggcttacgccccttggtccc

SEQ ID NO: 302046 - DNA, 527 bp, Homo sapiens
  misc_feature: GZ8MTXP01D6LNG.52.78.H01.1.454.CMB.2.raw
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattggtaccagcagagccaggccaggccccttatggtgatatataaggaccatgagacggccctcgagggactccctgagcgattcctctggctcctcctacagggcaacagtcacgttgatcatcagtggagtccggnaggaggacgagctgactattactgtacaatcaacagacagtagtgtaacttntgtgcgtggttcggcgggacgggaccaaggctaggacccgttcgttaggtcacgcccgaaggccgttccgcccccgttcggtaaccc

SEQ ID NO: 302047 - DNA, 519 bp, Homo sapiens
  misc_feature: GZ8MTXP01EOLU4.52.78.H01.1.454.CMB.2.raw
  modified_base (355)..(355): a, c, t, g, unknown or other
  misc_feature (355)..(355): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
  modified_base (510)..(510): a, c, t, g, unknown or other
  misc_feature (510)..(510): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaaggaccatgagaggcctcgagggatcccgtgagcgattctctcggctctctcaggaacacngtcacgtgatcatcagtggagtcggcagaggacgtagctgactatactgtacaatcaaacagacagtagtaggtacttatgtgctagtcggnggaaggacaagtcgngaccgtcgttaggttcacgcccgaaggcctccgccccgttggtaaccnccgttcccg

SEQ ID NO: 302048 - DNA, 519 bp, Homo sapiens
  misc_feature: GZ8MTXP01C9WXA.52.78.H01.1.454.CMB.2.raw
  modified_base (363)..(363): a, c, t, g, unknown or other
  misc_feature (363)..(363): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaaggaccatgagaggccctcaggggactcccgtgagcgattctctcggcctcctcctcagggaaccaacngtcacgttgatcatcagtggagtccgggcagaggacgaggctgactatactgtacaatacaaacagaacagtagtggtacttagtgtgcaggttcggcggaaggacaaggcttcgaccgtcttaggttcagcccagctcgccccnggtcncgtccg

SEQ ID NO: 302049 - DNA, 537 bp, Homo sapiens
  misc_feature: GZ8MTXP01CKV2L.52.78.H01.1.454.CMB.2.raw
  modified_base (242)..(242): a, c, t, g, unknown or other
  misc_feature (242)..(242): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagaggccaggccacggcccccttattcggtgatatataaggaccatgagacggccctcgagggactcccgtgacgcgtattctcgtggccttcctcctcgacgggacaacagtcacgttgatcatcagtggagtccgggnaggaggacggaggctgactattactgtacaatcaanagactagtaagtggttacttagttgtgngttaggttcggacgggtaagggaccaaggcgtacggaccgtccgttggtaacccg

SEQ ID NO: 302050 - DNA, 531 bp, Homo sapiens
  misc_feature: GZ8MTXP01EPND9.52.78.H01.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (321)..(321): a, c, t, g, unknown or other
  misc_feature (321)..(321): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttatggtacagcagagcagcagccctatgnatanataagacatgagaggcctcagggatcctgagcgattcnctggctcctcctacgagggaacaaacaggtcacgttgatcatcagtggagccggnaggaggacgaggctanactatactnacaatacaanagacgtagtagtagtaatgtgtagcgtggtaacgggacgggaacgggaacgttaaggcgtacggttaccgttcgttacggtaaccgacgaaccgacggccgttcccgtccccgttcgtcc

SEQ ID NO: 302051 - DNA, 640 bp, Homo sapiens
  misc_feature: GZ8MTXP01DIZVN.52.78.H01.1.454.CMB.2.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcggtggtttcgtgtaggctatttagaaggtgtcagtgtgaggcgcagctggtgggngtgtgggnggngttgtcgacgcggtcggggtccgtgacactctctgtgtgctcgtgtntctacttaactagttagtgatgtcgtcggtccgcgacgcgtcgaggagggngtggnggtggtggcgngngtgagngatgagtggaggtaggaggaagaacgtagtcgacggtacgtcgtggtaggacgggacgtacgtactacctacctacgaacgaacgaacaaacaactaacgaaacaaacgtaactaagtacgttacttaacgtaaccgtaaacgtagaacgacgacgtaccgtacgtaacgacgtaccggaacggaaccggtaccggtaaccggttacgttacgttacgttggtacggtacggttacggttcggtttacggtttaagggttaggttggtttcggttcggttcgtaaccgttaaccgtcg

SEQ ID NO: 302052 - DNA, 581 bp, Homo sapiens
  misc_feature: GZ8MTXP01ECF1D.52.78.H01.1.454.CMB.2.raw
  modified_base (409)..(409): a, c, t, g, unknown or other
  misc_feature (409)..(409): n is a, c, g, or t
  modified_base (475)..(475): a, c, t, g, unknown or other
  misc_feature (475)..(475): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagaggccaggccaggccccttatggtgatatataaggaccatgaagacggccctcgagggactcccgtgacgcgatttccctctggcctccctccctacgacgggaaccaacgacgtcacgtttgaatcatcgagttggagtccgggnaggaggacgaggctaggactattactgtacaatcaaacagacgagtagtaggtacttagtgtgcgnggttcgggcgggagggaacccgaaaggtcgtacggacccggttcgttacgggtccaacggcccgtaaacgggcccttccggtaaccccccgttcgggttaaccccg

SEQ ID NO: 302053 - DNA, 599 bp, Homo sapiens
  misc_feature: GZ8MTXP01CDE80.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctggagatgcactgccaaagcaatatggtatgtaccagcagagcaggccaggccccttatggtgatatataaggacatgagagccctcgagggactccctgacgcgtattcctctggctccctccgtacgacggggaacaaacgagtcacgtttgaacttcaactcgagtggacggtcccggggacagggaggaccggaggcctaggaacttaagttactacggttacaaattacgaaccaaggaacaaggttacgtagggttacttaagtcggtgcgtagggttaaccgggcgggaaagggacccgaaaggtcgtacgggacccgttcccgttagggcctacggccccgaagggcccttccgcccccgttcgggtaaccc

SEQ ID NO: 302054 - DNA, 525 bp, Homo sapiens
  misc_feature: GZ8MTXP01DV5Z3.52.78.H01.1.454.CMB.2.raw
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
  modified_base (474)..(474): a, c, t, g, unknown or other
  misc_feature (474)..(474): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtacagcagaggccaggccacggcccccttatggtnatatataagacatgagcgcctcgaggactcccgtgagcgtattctctcggtcctccctcctcgacgggacaacgagtcacgtgatcatcagtggagtcggnaggaggacgggaggctagactatactgtacaaatcaaacagacagtaagtagttacttagttgtgngttacggttcggcggaagggacaacgctacggaccgtcgttaaggtaaccg

SEQ ID NO: 302055 - DNA, 570 bp, Homo sapiens
  misc_feature: GZ8MTXP01D7JUY.52.78.H01.1.454.CMB.2.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccagcccctatgngatatataagacatgagagcctcgaggactcccgtgagcgtattctctcggctcctctcgaggaacaacngtcacgttgatcatacgaggtgacggtccgggacaggacggaacggagcgtagtaacctagttactagtacaatacaaacgagtaacaggtagtacggttaattatagtgtcgtacggttcgggcgggtaacgggacccaaaggtcgttacgtaccgtccgttacggaccgacgtaacccgaacgccgtccgccccgttcggtaacccttcgttccccg

SEQ ID NO: 302056 - DNA, 530 bp, Homo sapiens
  misc_feature: GZ8MTXP01DICQA.52.78.H01.1.454.CMB.2.raw
  modified_base (383)..(383): a, c, t, g, unknown or other
  misc_feature (383)..(383): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctggagatgcactgccaaagcaatatggttatggtaccagcagagcagccagcccctatgtgatatataaggaccatgagacggccctcgagggatccctgagcgattcctctggctcctcctcgacgggaacaacagtcacgttgatcatcagtgagtccgganagaggacgaggctgactattactgtaccaatcaaacagaacagtagtaggtattagtgtgctaggttcggcggaggggaaccaagcgtcgacccgttcgttacggcgacccgccgaacgccgttaccgtcccccgttcgggttcccc

SEQ ID NO: 302057 - DNA, 503 bp, Homo sapiens
  misc_feature: GZ8MTXP01BB45U.52.78.H01.1.454.CMB.2.raw
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaanatggtatggtaccagcagagcagccagcccctatgngatatataaggaccatgagagcctcgaggatcccgtgagcgattcnctggctcctcctcgagggacacagtcacgttgatcatcagtgagtcggcagaggacggaggctagactatactgtacaatcaacagacagtaagtggttacttagttgtgcttaggttcggacggtaagggaccaagccgtgacccgtcgttaaggtaaccg

SEQ ID NO: 302058 - DNA, 513 bp, Homo sapiens
  misc_feature: GZ8MTXP01C59KZ.52.78.H01.1.454.CMB.2.raw
  modified_base (462)..(462): a, c, t, g, unknown or other
  misc_feature (462)..(462): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggccctcagggatccctgagcgattctctggctccctcctcagggacaacagtcacgttgatcatcagtgggagtccgggcaggaggacgggaggctgactattctgtcaatcaacagacagtaagtggttacttangtgcaggttcggcgggtaagggacccaagctgacccgtcgttaagggtccg

SEQ ID NO: 302059 - DNA, 559 bp, Homo sapiens
  misc_feature: GZ8MTXP01EP3RY.52.78.H01.1.454.CMB.2.raw
  modified_base (279)..(279): a, c, t, g, unknown or other
  misc_feature (279)..(279): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggcaggcccctattgngatatataaggacatgagagccctcagggactccctgagcgattctctcggctctctcaggaacaacngtcacgttanatcatnagtgagcggngagaggagagctagactatactatacaatacgaacaagaactaggtagtagttaacgttagtgtgtacgtaggtacgggacgggaacgggaacgaacggtcgttacggtacccgttacgttaacggttccgaccggaacccgaacggtcccgtcccggcccccgttacggtaacccgttccgtccg

SEQ ID NO: 302060 - DNA, 544 bp, Homo sapiens
  misc_feature: GZ8MTXP01D49HY.52.78.H01.1.454.CMB.2.raw
  modified_base (430)..(430): a, c, t, g, unknown or other
  misc_feature (430)..(430): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctggagatgcactgaccaaagcaatatggttatgtacagcagagccaggccacggccccttagtggtgatatataaggacatgagacggccctagagggactcccgtagagcgtacttccgtctggcctccctcctacgaacgggaacaaacgacgtcacgttagactacatcgagtggacgtcgggcaggagacgagctagactagttacngtacaatacaaacagacagtagtagtaacttgtgtgcgtaggtcggacggacggacgaagcgtacgacccgttcttacgcgacgccgaaggccttccgccccgttaacggtccc

SEQ ID NO: 302061 - DNA, 548 bp, Homo sapiens
  misc_feature: GZ8MTXP01D39MB.52.78.H01.1.454.CMB.2.raw
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
  modified_base (540)..(540): a, c, t, g, unknown or other
  misc_feature (540)..(540): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacaggacggccaggatcacctgctctggagatgcactgaccaaagcaatatggttattggtaccagcagaggccaggccacggcccccttattcggtgatatataaaggaccatgagaggccctcgagggactccctgagcgattctctcggcctcctcctcgacgggaaccaacngtcacgttgactcatcgagtggagtccgggcagaggacgaggctgactattacngtacaatacgaacagaacagttagtggttacttagtagtgcgtaggttcgggcggaaggacaaggcgttagacccgtcgttagggttcacggccctaggctccgccccgttcggtcncgttcccg

SEQ ID NO: 302062 - DNA, 561 bp, Homo sapiens
  misc_feature: GZ8MTXP01DW1K2.52.78.H01.1.454.CMB.2.raw
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattgtacagcagagcaggccacggcccctatggtgatatataaggaccatagagacgccctcgagggactccctggagcgtattctctcggctcctctcgagggaaccaacngtacacgttagactcatcgagtgggagtccgggngaggaggacgaggctagacttatactgtacaatacaacgtaagactaagtagtcggttaatgtgtgcgtaggttcgggcgggaagggtacaaaggtcgcggtacccgtccgttaggttcaaccgcccgtaaggccttccgccccgttacggtccttaacgtttccccg

SEQ ID NO: 302063 - DNA, 599 bp, Homo sapiens
  misc_feature: GZ8MTXP01AZS39.52.78.H01.1.454.CMB.2.raw
  modified_base (356)..(356): a, c, t, g, unknown or other
  misc_feature (356)..(356): n is a, c, g, or t
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggccccctatggtgatatataaggacatgagaggcctcagggactccctgagcgattctctcggctcctcctcacgggaacaacngtacacgttgatcatcagtggagtccgggcaggaggacgagggctagactattactggtacaatcaaacagaccaggtagtggttacttagtggtntccgtaggttaccgggngggtaacggggaacccaaagggccgttacgggtaaccccggttcccgttaacgggttccgacggtaacccccgtaaagggggccccttacgggccccccccgttcggggttccccaaccgttttcccccg

SEQ ID NO: 302064 - DNA, 554 bp, Homo sapiens
  misc_feature: GZ8MTXP01AHIZV.52.78.H01.1.454.CMB.2.raw
  modified_base (362)..(362): a, c, t, g, unknown or other
  misc_feature (362)..(362): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggcccccttattggtgatatataaggaccatgagaggccctcgagggactcccgtgagcgattctctcggcctctcctcgaggaacaacngtcacgttgatcatcgagtggagtccgggcgaggaggacggaggctaggaactattactgtacaatcaaacagacagtagtggtactagtgtgtctaggttcgggcgggaacggacaaggcgttacgtacccgtcgttaggccacgaacccgacggtccgcccggtccccgttcggtccttaacgttccccg

SEQ ID NO: 302065 - DNA, 542 bp, Homo sapiens
  misc_feature: GZ8MTXP01AHXXT.52.78.H01.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (411)..(411): a, c, t, g, unknown or other
  misc_feature (411)..(411): n is a, c, g, or t
tcagcgcagtacgacacgaccggtgctcgatttagtgtgagtagtttgggtttgggggtgggtccaggaggcagaactctgggtgtctcaccatggcctggatccctctacttctcccactcctcactctctgcacaggctctggggcctcctatgaactgacacagccaccctcggtgtcagtgtcctcaggacagacggccaggatcacctgctctggagatgcactgaccaaagcaatatggttatggtaccagcagaggcaggccaggccccttatggtgatatataaggaccatgagacgccctnagggatcccgtgagcgattctcctggctcctcctcgaagggacaacngtcagttgatcatcagtgagtcgggcagaggacgaggctgacttattactttanaatcaactagacagtagtggtacttatgtgtcgtaggttcgggcgggaagggaccaaggcgttacgaccgtccgttaggttccacggcccgaagggccgttaccgcccccgttcgggtccaaccgttcccg

SEQ ID NO: 302066 - DNA, 736 bp, Homo sapiens
  misc_feature: GZ8MTXP01A3DOW.52.78.H01.1.454.CMB.2.raw
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctatttagaaggtgtccagtgtgaggcgcagctggtggagtcgtgggggagcttggtccagccgtgggggtccctgacnctctcctgtgtagcctcgtggattcaacctttaacagttatggatgacgttgggccncaggctcgagggagggctggagtgggtggccaggcgtagaagcagtgagtgggacgggtgaaggaagaacctagtcggcgggaaccttcgtgggtacgggaaacgggggtccctaacttcccgaaccctaccgttaccgaaggaacgaaaccaaaacgtactaaccgaaacgtaaacccttacgaaaattgttaacttaccccgttaacccaaaaagttccgggaaacgtaccaaacgtccccgttaaggaaccctaacgttaccccggggaaacgggaacccggtacccggggtaacccggtttaaaggttaccgttttaaccgttcggggttaaggacccgggttaaaggtttcgggttttaccggtttggggggttaatttcggggttttagggttcccggtttcggaacccgttaacccgtaacggg

SEQ ID NO: 302067 - DNA, 540 bp, Homo sapiens
  misc_feature: GZ8MTXP01D9BX1.52.78.H01.1.454.CMB.2.raw
  modified_base (358)..(358): a, c, t, g, unknown or other
  misc_feature (358)..(358): n is a, c, g, or t
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcgagggatccctgagcgattctctcggctcctctcagggaacaacngtcacgttgatcatcagtggagtcgggcagaggacgagctgactattacngtacaatcaacagacagtagtggtacttatgtgcgtaggttcggcgggaagggaaccaaggccgttagaccgtccgttacggttcgacggcccgaaggccgtccggcccccttcgggtcccaacgtttcccg

SEQ ID NO: 302068 - DNA, 535 bp, Homo sapiens
  misc_feature: GZ8MTXP01EEXGC.52.78.H01.1.454.CMB.2.raw
  modified_base (416)..(416): a, c, t, g, unknown or other
  misc_feature (416)..(416): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatcggtgatatataagaccatgagacggccctcgagggactccctgagcgattcctctggctccctcctacgagggtcaaacagtcacgttgatcatcagtggacgtcggcagaggacgagctgactatagtntacgaatcaacagacagtacgtaggtacttgtagtgcgtaggttcggacgggttaggacccaaaggcgtacgaccgttcttaggtcacgtccgaaggcttccgccccgttcggtaaccc

SEQ ID NO: 302069 - DNA, 651 bp, Homo sapiens
  misc_feature: GZ8MTXP01CUQ13.52.78.H01.1.454.CMB.2.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgacagcagngcagcacgccctatgnatananagcangagacgcctgaggactccctgacgcgtattctcgtccggcctcgtcctacgaacggaaacaacgcgtctacgttagactacagttcgagggtcggtaacgggtccccgggagaagggaacggaccgggaaggtcccgtaaggtaaccttaagttacgtacgtaaccgtaaataccgaaaacgagtaaaccgtaaggtttaaaggtcggttaaactttagtaggttacggccttaagggggttcccggggaacggggaagggtaaacccgagggtaccttacggaaacccgttcgttaacgggttccgaaccgaaccccgaacgggtccttcccggccccccgttggtcccttaaccggtttccccg

SEQ ID NO: 302070 - DNA, 654 bp, Homo sapiens
  misc_feature: GZ8MTXP01DXWDL.52.78.H01.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttcgtgttaggctatttagaaggtgtcagtgtgaggcgcagctggtggagtgtgggggaggcttgggtccagccgtggggggtcccctggacactctcctgtgtagcctntggattcaccttttaaanagttatgatgtcgttcggccacaggcncggagggagggngtggnggtggtggcgagcgagaganagtgagtaggaggtaggaaggaagaaacgtagtggacgtacgtacgtaggtaggaacgggacgtacgtacctacctaccgtacgaacgaacgaaacaaacaactaacaaacgaaactaactaaactagttaacttaaccgtaactaaacgtaacgaacgacgacgaccgtacgaacgtacgtaccgaacggaaccggaccggtaaccggtacgttacgttacgttacgtacggtacggttaggttcggtttacggtttaaggttaggttcggtttcggttcggttcgtccgttaaccgtaacg

SEQ ID NO: 302071 - DNA, 578 bp, Homo sapiens
  misc_feature: GZ8MTXP01CU820.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggcccccttatggtgatatataaggaccatgagacggccctcgagggactcccgtgacgcgattcctcgtcggctccctcctacgacgggaaccaaacgacgtactacggttgactcaatcagtggacggtccgggcaggaggacgaggctagactattactgtacaatacaacagaacagtagttggtacttaagtgtagcgtaaggttcgggcggttaagggaccaaggtacgtcgttacccgttccgttacgggtccacgaaccccgaacgggccttccggtccccccgttgggttaacccc

SEQ ID NO: 302072 - DNA, 538 bp, Homo sapiens
  misc_feature: GZ8MTXP01DOXT4.52.78.H01.1.454.CMB.2.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtacagcagngcagcacggcccctatggngatatataaggaccatgagacggcctcgagggactcccgtgagcgattctctcggcctcctcctcgacgggaaacaacncgtcacgttgatacatcagtggacgtccgggacaggaggacgaggctaggactattacgtgtacaactacgaaanagacagtagtggtatagtgtcgtntaggtcggnggaaggacgaagtcttgaccgtcgttacggttcacgtcccgaggcctccgccccttcggtccaacgttcccg

SEQ ID NO: 302073 - DNA, 549 bp, Homo sapiens
  misc_feature: GZ8MTXP01B0AGL.52.78.H01.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatataggttattggtaccagcagaggcaggccaggccccttatggtnatatataaggacatgagacggccctcgaggatcccgtgagcgattcctctggctccctctacgagggaacaacacgtcacgttgactcactcagtggacggtccggggcagggaaggacgaggccgtagactattactcgtacaatcaanagactagtagtgtacttatgtcgngtaggttcggacggagggtaccaagtcgtgaccgttcacggttcacgtaacccgaacggcttacccggtccccgttccggtaaccc

SEQ ID NO: 302074 - DNA, 596 bp, Homo sapiens
  misc_feature: GZ8MTXP01CNLQT.52.78.H01.1.454.CMB.2.raw
  modified_base (360)..(360): a, c, t, g, unknown or other
  misc_feature (360)..(360): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttattcggtgatatataaggaccatgagacggccctcgagggactccctgagcgattctctcggctcctctcagggaacaacngtcacgttgatcatcagtggagtccgggcaggaggacgaggctagactattactgtacaatcgaactagactaagtagtggtacttagtgtgtcctaggttcggcgggaacgggaaccgaaaggccgttacggtaaacccggttccgttaacgggttccgaaccgggtcccccgaaacgggtcccgtttaacccggacccccccgttacggggtccccttaaccgtttcccccggg

SEQ ID NO: 302075 - DNA, 726 bp, Homo sapiens
  misc_feature: GZ8MTXP01D3E9P.52.78.H01.1.454.CMB.2.raw
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagcaggccaggccccttatgtgatatataagaccatgagacggccctcgagggactccctgagcgtattcctcgtggcctccctcccgtacgaacgggaaccaaacgtacgtacctaaccgtttagaacttaccagttaccgtaagggttacggggaacgggttcccggggaccgaaggggaacgggaacggtaacgggccgttacggaaacgttaagtttaagggttacgttaaccggaaaattacccggaaaaaacgtaacggtaaacgtaaggttaacggttacggtttaaactttaggtcggttacggtaccggttaacggggtaaccggggtaacgggttaaaccgggtaaaccgttaacggtaccggttaccgggttaacccggttccgttaacgggtaacccgaaccggtaaccccggtaacggtcccgttaccccggtcccccgttcggtaacccg

SEQ ID NO: 302076 - DNA, 526 bp, Homo sapiens
  misc_feature: GZ8MTXP01D4EBW.52.78.H01.1.454.CMB.2.raw
  modified_base (331)..(331): a, c, t, g, unknown or other
  misc_feature (331)..(331): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgtactgaccaaagcaatatggttatggtaccagcagaggcaggccaggccccttatgtgatatataaggaccagtgagacggcccctgagggactccctgagcgattcnctggtcccctcctctcgaggaccaaacagtcacgttgatcatcaggtgagtcggcaggagacgagctgactattacngtacaatcaacgtanacgtagtagtagtacttagngttgcgtagttccggnggacgggaaccaggctcgacgtcgtaagcgcgaccaagggctcgccccncggttcnccgttctcccg

SEQ ID NO: 302077 - DNA, 513 bp, Homo sapiens
  misc_feature: GZ8MTXP01DJ602.52.78.H01.1.454.CMB.2.raw
  modified_base (348)..(348): a, c, t, g, unknown or other
  misc_feature (348)..(348): n is a, c, g, or t
  modified_base (412)..(412): a, c, t, g, unknown or other
  misc_feature (412)..(412): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatgtacagcagagcaggcagccctatgtgatatataaggacatgagaggccctcgagggactcccgtgagcgattctcgtcggcctctcctcgaggaacaacngtcacgtgatcatcagtggagtccgggcagaggacgaggctggactattactgtctaatcaaanagacagtagtgtacttgtagtgtctaggttcggcggaaggaccaaggcttaggaccctcgaagttcacgccgaagcgtcgccccttaggtccaacttcccg

SEQ ID NO: 302078 - DNA, 652 bp, Homo sapiens
  misc_feature: GZ8MTXP01BVGUJ.52.78.H01.1.454.CMB.2.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacatagccaccctcggtgtcagtgtcctcaggacagacggccaggatcacctgctctgganatgcactgccaaagcaatatggttattggtaccagcagagccaggccaggccccttatggtnatatataaggaccatagagacgccctcgaggggactcccgtgacgtcgtaacttcgtcgtcgggccttccctccgtacgacggggaccaacgtacgtacacgtttagacttcaagttcgaacggttgggacggtccggggacgaagggacgggaaccggggaaggtcccgtaggaaccgtttaattaccgtacgttacaaacttctaaacccgtaagaaccgtaaggttaaggttacgggtttaactttaacgttggttacggtacgttacggtttccggggacgggaacgggggtaccccaaagggtccgtaccgggttaacccggttcccgtttaagggtccccgg

SEQ ID NO: 302079 - DNA, 548 bp, Homo sapiens
  misc_feature: GZ8MTXP01CAXN0.52.78.H01.1.454.CMB.2.raw
  modified_base (406)..(406): a, c, t, g, unknown or other
  misc_feature (406)..(406): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
tcagcgcagtacgacacgaccggtgctcgatttagtgtgagtagtttgggtttgggggctgtgggtccaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctctggagatgcactgaccaaagcaaatattggttattggtaccagcagaggccaggccacggcccccttatggtgatatataaggaccagtgagacggccctacgagggactcccgtgagcgattccctcgtggcctcctcctacgagggaacaacacgtcacgttgatcatcagtggacgtcgganaggaggacgagcagactagtactgtacaatacaaacagacagtagtaggtacttagtgtncgtaggttcggnggacgggacagcgttcgaccgttcgttacggtaacacgcccgaaggccttccgccccgttcggtaacccg

SEQ ID NO: 302080 - DNA, 523 bp, Homo sapiens
  misc_feature: GZ8MTXP01C6T3S.52.78.H01.1.454.CMB.2.raw
  modified_base (358)..(358): a, c, t, g, unknown or other
  misc_feature (358)..(358): n is a, c, g, or t
  modified_base (424)..(424): a, c, t, g, unknown or other
  misc_feature (424)..(424): n is a, c, g, or t
  modified_base (458)..(458): a, c, t, g, unknown or other
  misc_feature (458)..(458): n is a, c, g, or t
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcgagggatccctgagcgattctctcggctcctctcagggaacaacngtcacgttgatcatcagtggagtccgggcaggaggacgaggctagactattactgtacaatcgaanagacagtagtggtacttatgtgtctaggttcggngggaaggacgaaggcttgaccgtcttaggttcagcccaggccncgccccttcggtccncgttccg

SEQ ID NO: 302081 - DNA, 615 bp, Homo sapiens
  misc_feature: GZ8MTXP01CKJ2Y.52.78.H01.1.454.CMB.2.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaattatggttatgtaccagcagagcagcacgccctatgnatanataagcatgagagcctgaggtactcccgtgacgcgtacttcgtctccggcctctccgtacgaggaaaccaacgcgtcgtaacgttgaactcagtcgaagtggacgccgggacaggaaggtaccggaggtaccgtaggaacttacttacgtgtaacaacttacggaaactaacgaacgtaggtagtaggtacttaatggtgacgtacggttcgggacgggtaacggaacccgttaggtacgttccgggtaaaccccgtcggttaacggcccgacggaaccccgttaagggccccgttccggaccccccgttggggtaaccccgttcccgtttccccg

SEQ ID NO: 302082 - DNA, 529 bp, Homo sapiens
  misc_feature: GZ8MTXP01CAF00.52.78.H01.1.454.CMB.2.raw
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggccccccttattggtgatatataaggaccatgagaggccctcagggatccctgagcgattcctctggctcctcctcagggcaacngtcacgttgatcatcagtggagtccgggcaggaggacgaggcctagactattactgtacaatcaacagacagtagtgtacttagtgtgcgtagttcggngttaaacggggaccaagcgtgaacccgttcttagggtcacgtccgaaggccttcgccccgttcggtccc

SEQ ID NO: 302083 - DNA, 558 bp, Homo sapiens
  misc_feature: GZ8MTXP01DNA2B.52.78.H01.1.454.CMB.2.raw
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgaccaaagcaatatggttattggtaccagcagaggcaggccaggcccccttatggtgatatataaggaccatgagaggccctcgagggatccctgagcgattcctctggctcctccctcagggaacaacagtcacgttgatcatcgagtggagtccgggcagagggacgaggctgactatactgtacaatcaaacagacaagtagtaggtacttatggtgcgtaggttcgggacgggacggggaacccaaggtccgtggaacccggttccttacgggttccgaacgccccgaacgggtccttccggtccccccgttcgggttaacccc

SEQ ID NO: 302084 - DNA, 561 bp, Homo sapiens
  misc_feature: GZ8MTXP01B9GZ7.52.78.H01.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacnctctcctgtgtagcctntggattcacctttaacagttatggatgacgttggtccncaggcctccgagggaaggggctggagtggggtgccagcgtgagcatgatgggagtgagaagaactagtcggactcgtggtaggaacgggccgtattccgaaccctaccttaccgaagacgaacaaacatacaaagtaactacaatgtatacctacaaatgacgcagcctgacactcgaagcgacggcctaagtnttacgngttgacgtgttagtttcggttggtaattggttcgttcgttcgcctcgcgtcccg

SEQ ID NO: 302085 - DNA, 635 bp, Homo sapiens
  misc_feature: GZ8MTXP01CRH3C.52.78.H01.1.454.CMB.2.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (621)..(621): a, c, t, g, unknown or other
  misc_feature (621)..(621): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacngcagagcagcagcccctatgngatatataagacatgagagcctcgaggactcccngagcgattctctcggcctctcctcgaggaacaacngtcacgttagactcgaatcgagtgtacggtccgggacaggaaggaccggaaggtccgtaggaaccttaattaccgtgtactaaatcaaacaggaacctaaggtaagttggtaactttagtaggtgtaccggtaggttccgggcggggaacggggaaaccttaaacgggtccgttacgggtaaaccccgttccgggttaaaacgggttccgaaaccgggtaacccccgaaaacggggtcccgtttacccggcccccccggttccgggtttaacccncccgttttccccgg

SEQ ID NO: 302086 - DNA, 563 bp, Homo sapiens
  misc_feature: GZ8MTXP01DEU1D.52.78.H01.1.454.CMB.2.raw
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctgganatgcactgaccaaagcaatatggttattggtacagcagngcagccagccccttatgtgatatatagacatgagngcctnaggntcctgagcgattcctctggctccctcctacgagggtaacaacagtacacgttgatcatcagtggagtcggcaggaggacgaggctgactatactgtacaagtcaaatacgacagtagtggttaacttagtgtgcgtaggtttcgggacgggttaagggaacccaaggtaccgtacggttacccgttccgttacgggttaaccgaacggtccccgaaacgggtccgttaccgtaacccccggttcgggttaaccccg

SEQ ID NO: 302087 - DNA, 528 bp, Homo sapiens
  misc_feature: GZ8MTXP01DKUD8.52.78.H01.1.454.CMB.2.raw
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
  modified_base (520)..(520): a, c, t, g, unknown or other
  misc_feature (520)..(520): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagagcaggcaggcccctatgtgatanataaggacatgagaggccctgagggactcccgtgagcgattcnctcggctctcctcgaggaacaacngtcacgttgatcatcgagtggagtcgggnagaggacgaggctgactatacgtgacaatcgaaacgagaactagtagtggtacttagtgtgtcgtaggttcgggcggaaggaccgaagccgttagaccgtcgttaggttcacggcccaaggcctccgccccttcggtccncgttcccg

SEQ ID NO: 302088 - DNA, 561 bp, Homo sapiens
  misc_feature: GZ8MTXP01CARAY.52.78.H01.1.454.CMB.2.raw
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccaggccccttatggtgatatataaggacatgagaggccctgagggatccctgagcgattccnctggctccctctacagaacacagtcacgttgatcatcaggtggacggtccgggagaggaggacgagggctagactatactgtacaatcaaanagaacagtagtagttaattatggtgcgtagggttcgggacgggttaagggaccaaaggtcgtacggacccggttccgttaacgggtccaccggaacccgaacgggtccgttacccggtcccccgttcgggtaacccc

SEQ ID NO: 302089 - DNA, 534 bp, Homo sapiens
  misc_feature: GZ8MTXP01BO5MH.52.78.H01.1.454.CMB.2.raw
  modified_base (465)..(465): a, c, t, g, unknown or other
  misc_feature (465)..(465): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggcccccttatggtgatatataaggaccatgagaggccctcgaggactccctgagcgattcctctggctccctcctcgacgggcaacagtcacgttgatcatcagtggagtccgggcgaggacggacgaggctaggtactattactgtacaatcaaacagacagtagtgttactatgtgcgtggttcgggnggacgggtaccagcgtcggaccgttcgttacggtcacgcccgaaggccttccgccccgttcggtaaccc

SEQ ID NO: 302090 - DNA, 628 bp, Homo sapiens
  misc_feature: GZ8MTXP01DD452.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcggggacagacggccaggatcacctgctctggagatgcactgaccaaagcaatatggttattggtaccagcagaggccaggccacggcccccttatggtgatatataaggaccagtgagacgccctagaggactccctggacgcgtattctctcggtccctcctctcgacggacaaacagtcacgttgactacatcgaggtggacgtcgggacgaggacggacggacggtacgtacggtaacttaacggttacttgtaacctaaagttaccaaaaccgaaggtaaacgtaaggttaaacggtaggtttaactttagtaggttagccgtaagggttccgggacggaacggggtaaccaacggttcgtaccgacggtaccgtacggttcgacgacccgaaggcgtcccgaccccggtcgttcctaaccgttcgttccccgg

SEQ ID NO: 302091 - DNA, 577 bp, Homo sapiens
  misc_feature: GZ8MTXP01C6CLH.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagctaatatggttatcggtacagcagagcaggccacggtccccttagtcggtgatatagtaaaggaccatgagacggcctacgaggactcccgtgagcgtattctcgtcgcctctcgtcaggaacaactgctacgtagactcatcgagtcggacggtccggagaggaggacgacggctagtaccgttaattacgtacgtactaaacgtacaaacgagaactaaggtagttaggtacttagtagtgtacgtaggttcgggacgggaacgggaacaaggtcgacgtaccgtacgttacgttcaccggaaccgaagtccgcccgtcccgttcgtccgaacttcccg

SEQ ID NO: 302092 - DNA, 513 bp, Homo sapiens
  misc_feature: GZ8MTXP01EK058.52.78.H01.1.454.CMB.2.raw
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggccctcagggatccctgagcgattccnctggctcctcctacaggaacaacagtcacgttgatcatcagtgagtcggnagagacgagcngactatactgtacaatcaaacagacagtagtggtacttagtgtgtcgagttcgggcggaggggaccaaggctgaccgttcgttaggtcagcccgaagccttcgccccttggtccc

SEQ ID NO: 302093 - DNA, 627 bp, Homo sapiens
  misc_feature: GZ8MTXP01EXFHC.52.78.H01.1.454.CMB.2.raw
  modified_base (219)..(219): a, c, t, g, unknown or other
  misc_feature (219)..(219): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagcgcagtacgacacgaccggtgctcgatttagtgtgagtagtttgggtttgggcacgaccggtgctcgatttagtgtgagtagttggtttgggggtgggtccaggaggcagaactctgggtgtctcaccatggcctggatccctctacttctccccctcctcactctctgcacaggctctggggcctccctatgaactgacacagccaccctcggngtccagtgtcctcagggacagacggccaggatcacctgctctggagatgcactgccaagcaatatggtatggtaccagcagngcacgcagcccccttatgcgatatataaggaccatcgagacggccctcgagggaactcccgtgaagcgnttcctntcgggctccgtcccttcgagggacaacgagtacgtaccgtgactccgtaattccgaaggtaggacggtacccggggggggacgaacgggacgggacggacggtacgtacgtaacgttacgtacgtacgtaactaacgtaaccgaacgtaacgttaacgtaaggttacggttacggttcaaacgtttcggttacggttccgacggttaacgggtaccgggtacgggttaccgggtaaccgaaccggtaaccg

SEQ ID NO: 302094 - DNA, 568 bp, Homo sapiens
  misc_feature: GZ8MTXP01CX52E.52.78.H01.1.454.CMB.2.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (340)..(341): a, c, t, g, unknown or other
  misc_feature (340)..(341): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttctgtagctatttagaaggtgtcagtgtgaggcgcagctggtggagtcgtgggggagcttggtccagccgtgggggtccctgacnctctcctgtgtgcctntggattcacctttaanagttatggatgacgttgggccncgaggctcgagggagggctggagtgggtgccagcgtgaagnngngagnggagngagagaatagnggcgtatgtggacggacggctactaccacctacgtacgaagaacaacaacaacaacaacgaactaactaatactaactacgtaactaaacgtacgacgacgacgcgtacgacgacgtaccgacgaccgaccggtaacgtacgttacgttacgttgtgtcgttaggttcgttcggttggttgttggttgttcgttcgtccgcgtcg

SEQ ID NO: 302095 - DNA, 520 bp, Homo sapiens
  misc_feature: GZ8MTXP01AZDVN.52.78.H01.1.454.CMB.2.raw
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
tcagcgcagtacgacacgaccggtgctcgatttagtgtgagtagtttgggtttgggggctgtgggtccaggaggcagaactctgggtgtctcaccatggcctggatccctctacttcctcccctcctcactctctgcacaggctcgtggggcctcctatgaactgacacagcccaccctcggtgtcagtgtcctcaggacagacggccaggatcacctgctctggagatgcactgccaaagcaatatggttatggtacagcagagcagccaggccctatgnatanataagacatgagacggccctcgagggactccctgacgcgattcctctggcctcctcctcacgggaacaacgagtcacgttgatcaatcagtggagtccgggnaggaggacgtagggctgactattacngtacaatcgaacagacagtagnggttacttagtgtgcaggttcggcgggagggaccaagcgtgaccgttcttagggcaagccccgaaggcttcgccccgttcggtcc

SEQ ID NO: 302096 - DNA, 606 bp, Homo sapiens
  misc_feature: GZ8MTXP01APEAE.52.78.H01.1.454.CMB.2.raw
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagcccaccctcggtgtcagtgtcctcgaggacagacggccaggatcacctgctctggagatgcactgaccaaagcaatntggttatgtacagcagagcagcacgccctatgnatatanaagcangagacgcctcgagggactcccgtgacgtcgtattctcgtcggcctcctccgtcgaggggaaaccaacgtaacgtcgtaacgttgactcatcgtaggtacggagtccgggacaggacggacgagggcttagacgtattacgtacgtacaaactacgaaacgaacgtactacggttaagttcggtaacttacgtggtcgtcgtaacggttccgggacggtaaggaacccaaaggtcccttacgggaacccgttcggttaacggcgaccggaaccccgaaggtcccgtccgtcccccggttcggtaaccaaccgtttccccg

SEQ ID NO: 302097 - DNA, 700 bp, Homo sapiens
  misc_feature: GZ8MTXP01ENYKY.52.78.H01.1.454.CMB.2.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (363)..(363): a, c, t, g, unknown or other
  misc_feature (363)..(363): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatagttcgttagtcgacagcgangcgacgaccggaccgtaccgtacccgttacgttagtagtagtaataagtaaacgtaacgtacgtaggtacgacggtaccgtacgtacggtacgtaccngtacccgtacggtacgtacgttccgttccgttccgttcccgttcccgtacccgtaaccggtaaaccggtaaaccgtaaaccgtaacgtaacgttacgttacgtacgtacgtacgtacgtacggtacgggtacgggtaccgggacggacggacggacggacggtacgtacgtacgttacgttacgttacgtacgtaacgtaacgaacgaacgacgtagtagtagttacgttagtgtcgttcggtacggttacgggtacgggtacgggaccggacggttaccgtaacggtaccggtaaccggtaccggtaccgaccgtaacccggaacccggtaacccg

SEQ ID NO: 302098 - DNA, 575 bp, Homo sapiens
  misc_feature: GZ8MTXP01AQMVX.52.78.H01.1.454.CMB.2.raw
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagtggtgatatagtaacggaccatgagacggccctcgagggactcccgtgacgcgtattccctcgtggcctccctcctacgacgggaacaacagtccacgttgancatcgagtcgggacggtccgggacgaggacgggacggaggcgtagactattactggtacaatacaanagactagtagtggtacttagtgtgcgtaggttcggacgggttagggaaccaggtcgtcggacccgttcgttaggtaacccacgtccccgaaggtcccgttccgccccgttcggtcccc

SEQ ID NO: 302099 - DNA, 560 bp, Homo sapiens
  misc_feature: GZ8MTXP01DXCNP.52.78.H01.1.454.CMB.2.raw
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (436)..(436): a, c, t, g, unknown or other
  misc_feature (436)..(436): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (538)..(538): a, c, t, g, unknown or other
  misc_feature (538)..(538): n is a, c, g, or t
  modified_base (552)..(552): a, c, t, g, unknown or other
  misc_feature (552)..(552): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctatttagaaggtgtccagtgtgaggcgcagctggtggagtcgtgggggaggcttggtccagccgtggggggtccctgacactctcctgtgtacgcctctggattcaacctttaangttatggatgacttgggtccncaggctccgagggagggctggagtgggtggccagcgtgaagcatgagtgggaggtgaggaagactagtggcggactcgtggtaggaacggggcgtacttccaaccgtacttcccgaagacgaacaaacntaccaaagactacgaattcgtactactacaaatgaacgctagccctggaaacncgtacgagacgcggtctgttatcgttgngngttagttgtttcgtgggtnttggttgtcgttcnccgcgtcg

SEQ ID NO: 302100 - DNA, 687 bp, Homo sapiens
  misc_feature: GZ8MTXP01ECYU1.52.78.H01.1.454.CMB.2.raw
  modified_base (472)..(472): a, c, t, g, unknown or other
  misc_feature (472)..(472): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcaggacgccgaggcccacggtccccctttagtcggtagtatataataaggaccatcgagacggccctacgacgggaactcccgtgacgcgtattctcgtcggtctcctacctcgaacgggacaacgacgtcaacgttagattacattacgaggtaggacggtcccggggganaacgggaacgggaacggacgggtctacggtaactttaaagttacccgtggtaacctaaacgttaacaaaacgtaaccgaacgttaaacggttaaacggttaaggggtttaacctttaaaaggttggttaccggtaacgggttaaacgggtttcccgggggtaacgggggtaaacggggaaacccggtaacggttaacccggtttaaaccccgggg

SEQ ID NO: 302101 - DNA, 619 bp, Homo sapiens
  misc_feature: GZ8MTXP01CSWI5.52.78.H01.1.454.CMB.2.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttatggtacagcagagcacggcacgccctatggtgatatanaagacatagagacgcctgagggtactcccgngacgcgacttctcgtcggcctccgtcctacgaacgggaaacaacgtcgtaccgtaacgttgactacacgtcgaggtacggacggtacccggggagagggacggacggaggtcgtacgtaacgttacgttaacgtctaacgaaacttacaaacgtaaggaaccgtaggttaaggtagttaacgtttatagggtagtaccggtaggttccgggaacgggaacgggtaaccgaaggtcgttacggtaccgtcgttacgcgacggaaccgacgtccgtcccgtccccgttcgtaaccgcgtttcccg

SEQ ID NO: 302102 - DNA, 542 bp, Homo sapiens
  misc_feature: GZ8MTXP01CAQ2H.52.78.H01.1.454.CMB.2.raw
  modified_base (351)..(351): a, c, t, g, unknown or other
  misc_feature (351)..(351): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctgggcctcctatgaactgacacagccaccctcggtgtcagtgtcctcaggacagacgaccaggatcacctgctctggagatgcactgaccaaagcaatatggttattgtaccagcagaggcaggccaggccccttatggtgatatataaggaccatgagaggccctcagggatcccgtgagcgattctctcggctctcctcaggaacaacngtcacgttgatcatcagtgagtcggcagaggacgaaggctgactattactgtacaagttcaaactagaacgtagtaagtggtacttagtagtgtccagttcgggcgggaagggtaccaaaggtcgttcgaaccgtcgttacggttcgacgcccgaaggcctcgacccccgttcggtccttaacgttccccg

SEQ ID NO: 302103 - DNA, 518 bp, Homo sapiens
  misc_feature: GZ8MTXP01AD7DI.52.78.H01.1.454.CMB.2.raw
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (480)..(480): a, c, t, g, unknown or other
  misc_feature (480)..(480): n is a, c, g, or t
  modified_base (510)..(510): a, c, t, g, unknown or other
  misc_feature (510)..(510): n is a, c, g, or t
tcagcgcagtacgacacgaccggtgctcgatttagtgtgagtagtttgggtttggggaggtctcggagaggagccttagccctggactccaacggcctttccaacttggtgatcagcactgagcacagaggactcaccatggagttggggctgagctgggttttccttgttgctattttagaaggtgtccagtgtgaggcgcagctggtggagtctggggggaggcttgggtccagccgtggggggtccctgacactctcctgtgtagcctntggattcacctttaacagttattggatgacttgggtccncaggctcagggaggggctggagtgggtgcagcgtgaagcatgatggagtgagagaacangcggactngtgaagggcattcacacttcaganacaacatcaagaactcaaatgtaatcgtacaaagtgaagcagcctgacatcgagacacgccgtgttattacttgtggngagttgttgttggtgtgttgtcgttcgtcnccgtaacg

SEQ ID NO: 302104 - DNA, 524 bp, Homo sapiens
  misc_feature: GZ8MTXP01B5HOQ.52.78.H01.1.454.CMB.2.raw
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccgccaggctccgaggggaaggggctggagtgggtggccagcgtgaagcatgatggagtgaggaagaactatgcggactctgtgaaggggccattcacactcagagacaacatacaagaactcaatgtaatcgtacaaatgagcagcctgacntccgagacncggccgtgttattacngtgcgagngttcgttggggattggttgtcgttgcgttccgcg

SEQ ID NO: 302105 - DNA, 645 bp, Homo sapiens
  misc_feature: GZ8MTXP01EPMNB.52.78.H01.1.454.CMB.2.raw
  modified_base (281)..(281): a, c, t, g, unknown or other
  misc_feature (281)..(281): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggtttatggtaccagcagaggccaggccacccgggttancccgtatgtgatagtaactaagtacgagtagacgacggacccgtacgacggtacgtaccgtcgacgctacttcctcgtcggtcctccctccctacgaacgggaccaaacgtacgtacgtacgttagactactactacgtaggtaggtacggtccgggacgaggacgggacggacggcgtacgtaacttaacgttacgtacggtactaaactaaccaaacgaacgaacgtaagtaaggttacgttaacgttagtagtacgtacgtaacggttcgggacgggtacgggaaccgtaacggtacgttacggttacccgttaccgtaacggtacgaaccgacccgacggaccgtcccgttccccgtccg

SEQ ID NO: 302106 - DNA, 510 bp, Homo sapiens
  misc_feature: GZ8MTXP01EYJEQ.52.78.H01.1.454.CMB.2.raw
  modified_base (463)..(463): a, c, t, g, unknown or other
  misc_feature (463)..(463): n is a, c, g, or t
  modified_base (483)..(483): a, c, t, g, unknown or other
  misc_feature (483)..(483): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggcctcagggatcccgtgagcgattctctgggctccctcctcgacgggtacaacagtcacgttgatcatcagtggagtccgggcagaggacggaggctgactattactgtacaatcaacagacagtaagtggttactnttagtgcagttcggacgggnggaccaagctgaccgtcgttggtaacc

SEQ ID NO: 302107 - DNA, 712 bp, Homo sapiens
  misc_feature: GZ8MTXP01CH92B.52.78.H01.1.454.CMB.2.raw
  modified_base (223)..(223): a, c, t, g, unknown or other
  misc_feature (223)..(223): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggcaggatcactgctctgganatgcactgaccaaaagcaaattagttggttattggtaccagacaagaggccaggccacggtccccctttagtggtgaatataagtaaggaccaagtgaacgtacggaccccgtagaacgggtactacccgttggaacgtcggtaactttccccgtcgtacgggtcccttacccgtcccgtaacgaaacgggtaaccaaacgtacgttaccgtaacggtttacgaactacgtaacgttacgtaacggttggggaccgggttacccggggacgaaacgggaagggaaccggaaggtccgtacggtaacctttaaagttaacgttcggtaaacgtaaacttacccgaaagaaccgaagtaagtacggttaggttaaaccttagtggtacgtgtagggtttccgggcggttaacggggaacccttaggcgtacgacccggttcgacgggtccaaacgtcccgaaggtcccgccgtccccgttcgttaaccccg

SEQ ID NO: 302108 - DNA, 745 bp, Homo sapiens
  misc_feature: GZ8MTXP01AWKJY.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggtccccttagttggtgatatataaggaccatgagacggccctacgagggactcccgtagacgcgtactttcgtcgtcggtcctccgtcccgtacgaacggggaaaccaaaccgtcgtaccgtaacgtttacggaacttccgaacgttccgaaagggttcgggtaacgggttaccccgggggagaacggggaacgggtacgggaacgggtcgtacggtaaccttaagttaccgtagttaacaaacgttaccgaaaacgaacgtaaccgtaaggttaaggttccgggttaaatttaagttagggttcgtaccggtaaacgggtttccggggacggggtaaacggggtaaacccgttaaacgggccttaccgggtaaccccggttacggttaaccgggttccgaaccggtaaccccggaaaccggtccggtaccccggtccccccgttccgggttaaccaaccccgtttccccg

SEQ ID NO: 302109 - DNA, 773 bp, Homo sapiens
  misc_feature: GZ8MTXP01ANXNP.52.78.H01.1.454.CMB.2.raw
  modified_base (242)..(242): a, c, t, g, unknown or other
  misc_feature (242)..(242): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatagtagttattcggaccagacaggacgaccgacggaccgaccgtaccccttagttggtagtataataagtaacggacctagtagacggacgccctacgagggtctccgtgacgtacgtattcctcgtcggtcctcccgtccgtacggaacgggaaccaacgtacgttaccgtaaccggtttaacgtaacttacgtaacgtacgggtaacgggtacggggtaccgggtaccgggaacggaaacgggtaacgggaacggggtacggtacgttaacgttaaaccgtttaacgttaacgtaacgtaaaccgtaaacgtaaaccgtaaacgtaaacgtaaacggtaacggttaacggttaacggtttaacggtttaacggttacgggttaacgggttaacgggttaccggggttaccgggggttaaccgggggtaaacccggggtaaacccgggtaaaccgggtaaccgggttacccgggttaacccgggttaacccgggttaacccgggtaacccgg

SEQ ID NO: 302110 - DNA, 568 bp, Homo sapiens
  misc_feature: GZ8MTXP01CBP6J.52.78.H01.1.454.CMB.2.raw
  modified_base (429)..(429): a, c, t, g, unknown or other
  misc_feature (429)..(429): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccacggccccttatggtgatatataaggaccatgagagccctacgagggatcccgtgacgcgtattctctggcctcctccgtcgacgggacaaacgtacgtactacgttgactcgaactccgaggttcggacggtcccggganaacgggacggacggggaggtcgtaggaacttagttaccgtgtactaaatcaacagactaaggtaagtgttacttagttgtgcgttaggttcgggacggaagggaccaaggtcgtacggaccgttcgttaaggtaacccg

SEQ ID NO: 302111 - DNA, 674 bp, Homo sapiens
  misc_feature: GZ8MTXP01B1EY2.52.78.H01.1.454.CMB.2.raw
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacgccaggatcacctgctctggagatgcactgaccaaagcaatatggttatggtaccagcagaggcaggccaggccccttatggtnanatataaggaccatgaagacggcccctagagggactcccgtgaacgcgatttccgtctggcctcccgtcctagaacgggaacaaaccgtagtcgaaacgtttgaacttcaaacgttcgaaggttggaacggtcccggggacaaagggaaccggggacggtaaggccgttacgggaacgtaactttaaacgttaggtttaccgaaagttaacgtaaaaccctaaacgtaaacgaaacggttaaggttacggggtttaacgtttaaacttacggtttcggacggtacggtttaagggtacggggacggggtaaacccgaaagacgtacgttaccgttccgttacggtaacgacgaacccgaacgacgttaccgccccgttccggttcccg

SEQ ID NO: 302112 - DNA, 732 bp, Homo sapiens
  misc_feature: GZ8MTXP01C9Z1K.52.78.H01.1.454.CMB.2.raw
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggcccgacggtcccccttagttggtgtatataagtaaacggaccagtggagacggccctacgagggtactcccgtagacgcgtacttctcgtcggccttcctcctacgacggaaccaacncgtctacgtgactactatcgagtggacggtccggganagggacggacggaggcgtaggtaacttattacgtgtaactaattaccgaaacgtacggtaaacgtaggttaacggttagttaacgtttagtacgggtcggtacgttaaacggggttccgggggaacgggggtaaaccgggtaaacccggaaacgggttccgggtttaacccggtaaccccgggtttacccggttaaaccgggggttcccgaaacccgggtaacccccgggtaaacggggtccccggtttacccccgggaccccccccggtttaccggggttccccttaacccggtttttcccccccggg

SEQ ID NO: 302113 - DNA, 636 bp, Homo sapiens
  misc_feature: GZ8MTXP01C7Y18.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctcgtggattcacctttaacagttatggatgacttgggtccgcaggctccgagggagggctggagtgggtgccagcgtgaagcatgatgggaggtgaggaagaactatggcgactcgtgtggaagggcattccacctacttcagagaacaacatacaaagaactcaaattgtaactctaccaaagtgacgacacgtcctaggaaccacgtacccggaaggaacccgaccggggtcccgttagttaaacgtttaccgttgggtttacggacccggttaaagggtttcgggtttttcccggttttaaggggggtacttttggggtttttccgggttacggttttccgggcccttaaaaccccggtaaccggg

SEQ ID NO: 302114 - DNA, 543 bp, Homo sapiens
  misc_feature: GZ8MTXP01ALVA5.52.78.H01.1.454.CMB.2.raw
  modified_base (278)..(278): a, c, t, g, unknown or other
  misc_feature (278)..(278): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
tcagcgcagtacgacacgaccggtgctcgatttagtgtgagtagtttgggtttggggctgtgggtccaggaggcagaactctgggtgtctcaccgatggcctggactccctctacttctccccctctcactctctgcacaggctctgggcctcctatgaactgacacagccacctcggtgtcagtgtcctcaggacagacggccaggatcgacctgctactggagatgcactgaccaaagcaatatgttatggtacagcagagcagccagccctatgngatatataagacatgagacgcctacaggactccctgacgcgtacttcctctggcctccgtacctcgagggcaacagtcacgttgatnactgagtgagccgganagaggacgagcaggactagttactgacgaatcanacgatagtagtaccggtattagtgttcagtcggttcgggacggacggggacccaaggccgttacggacccgttcgttaacggcacggaacccgaaacgggcccttacgccccccgttggttaaccccg

SEQ ID NO: 302115 - DNA, 546 bp, Homo sapiens
  misc_feature: GZ8MTXP01EX2EO.52.78.H01.1.454.CMB.2.raw
  modified_base (352)..(352): a, c, t, g, unknown or other
  misc_feature (352)..(352): n is a, c, g, or t
  modified_base (442)..(442): a, c, t, g, unknown or other
  misc_feature (442)..(442): n is a, c, g, or t
  modified_base (538)..(538): a, c, t, g, unknown or other
  misc_feature (538)..(538): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatcgtacagcagagcagcacgccctatgtgatatataagacatgagacgcctgaggactcccgtgagcgtattctctcggcctcctcgtacgacggaaacaacgngtactacgttagacttcaagtcgaggtcggacggtccgggacgaggacggacggaaggctagtaacctaattacgtagtacaatacaaanagaacagtagtggtacttatgtgtgtagtcgggagggaaggacaaggcgttcgaccgtcgttaggcacggaaccgagcctcgccccgcggtaaccncgttcccg

SEQ ID NO: 302116 - DNA, 571 bp, Homo sapiens
  misc_feature: GZ8MTXP01CA4HJ.52.78.H01.1.454.CMB.2.raw
  modified_base (292)..(292): a, c, t, g, unknown or other
  misc_feature (292)..(292): n is a, c, g, or t
  modified_base (509)..(509): a, c, t, g, unknown or other
  misc_feature (509)..(509): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtaccagcagaggccaggccaggcccccttattggtnatataataaggacatgagacgccctcgagggactcccgtgacgcgtatttccctcgtggccttccctccctacgaacgggtaacaaaccgacgttcgacgtttgaacttcaattcgaaggtgggacggtcccgggagaggaacgggaccgagggctagacttagttactgtactaaatcgaaacagacgtagtagtgtaactgtgtgcgagttcggnggagggaccaggacgtcgaccgttcgttaggtcacgccgaaggccttcgcccccgttgtccc

SEQ ID NO: 302117 - DNA, 566 bp, Homo sapiens
  misc_feature: GZ8MTXP01C3V4U.52.78.H01.1.454.CMB.2.raw
  modified_base (347)..(347): a, c, t, g, unknown or other
  misc_feature (347)..(347): n is a, c, g, or t
  modified_base (510)..(510): a, c, t, g, unknown or other
  misc_feature (510)..(510): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggcttgggtccagcctggggggtccctgacactctcctgtgtagcctctggattcacctttaacagttatggatgacttggccgcaggctccgaggaagggctggagtgggtgccagcgtgaancatgatggagtgaggagaactatgcgactctgtgagggccattcacactccagagacaaacatacaaacgaactacaaatagtaatacgttacccaaaagtagaggcaacggccctagaaacagtaccccgaaggaaccgaccggccggtgttaattaaccgngttggcgttaggttgtttacgtttggggaattgtttagtcgtttgccaaccgtaag

SEQ ID NO: 302118 - DNA, 629 bp, Homo sapiens
  misc_feature: GZ8MTXP01B8MOO.52.78.H01.1.454.CMB.2.raw
  modified_base (226)..(226): a, c, t, g, unknown or other
  misc_feature (226)..(226): n is a, c, g, or t
  modified_base (516)..(516): a, c, t, g, unknown or other
  misc_feature (516)..(516): n is a, c, g, or t
tcagcgcagtacgacacgaccggtgctcgatttagtgtgagtagtttgggtttggggctgtgggtccgaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctctgganatgcactgaccaaaagcaattagttggttattggtaccagcagaggccaggccacggtcccccttattggtagataatagtaaacggaccataggagacggccctacgagggactccccgtgagcgtattccctctggcctccctcctaacgacgggaacaaacacgtccacgttgactcatcgagtgggagccgggacaaggaacgggacgaggtctagtatacttactcgtacaaataccaaacgaacgtaacgtagttaagttaggttaactttagtaggtgtacgngggtttaaccggggcggaacggggaaaccaagggtcgtacgggttaccccggttcgttacgggtaaccaccgtcccgaagggcccttccgtccccccccgttgggttaacccg

SEQ ID NO: 302119 - DNA, 641 bp, Homo sapiens
  misc_feature: GZ8MTXP01EW48R.52.78.H01.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagagcaggccacgtccctatgngatanagtaaggacatgagacgccctagaggactcccgtagagcgtattctcgtcggccttcctcctcgacgggtaaaccaaacgcgtacgtaaccggttagacttacctaagtcgtaagggttggaccgggttcccgggagaaggagggacggaaggtcctaggtaaccttaagttactaggttaacaaacttaccgaaacgtaacggtaagtaaggttagttacggttatttaagtcggtagtacgtacggttccgggacggggaacggaacttaacggtcgttacggtacccgtacgttacggttcgaccggcccgaaggtcccgtacccgccccggttgtaaccgttccgttcccgg

SEQ ID NO: 302120 - DNA, 574 bp, Homo sapiens
  misc_feature: GZ8MTXP01EYVIM.52.78.H01.1.454.CMB.2.raw
  modified_base (307)..(307): a, c, t, g, unknown or other
  misc_feature (307)..(307): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (573)..(573): a, c, t, g, unknown or other
  misc_feature (573)..(573): n is a, c, g, or t
tcagcgcagtacgacacgaccggtgctcgatttagtgtgagtagtttgggtttggggaggtctcggagaggagccttagccctggattccaaggcctttccacttggtgatcagcactgagcacagaggactcaccatggagttggggctgagctgggttttccttgttgctattttagaaggtgtccagtgtgaggcgcagctggtggagtctgggggaggcttgggtccagccgtggggggtccctggacactctcctgtgtagcctctggattcactttaacagttatggatgacttgggtccnccaggctccgagggaggggctggagtgggtggccagcgtgaagcatgatggaggtgaggagaactatgcgatctgtgaagggccgattccacacttccagagacaacatcaagaactanaatntatactacaatgancagctacgacacgtaccggaggaccgcgggtccgttagttacgttacgttcggtaggtacggttaagttcggttttcgggtttaaggggtactttcgggtttcggttcggttacggaaccgttaaccgng

SEQ ID NO: 302121 - DNA, 618 bp, Homo sapiens
  misc_feature: GZ8MTXP01A11E0.52.78.H01.1.454.CMB.2.raw
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
  modified_base (414)..(414): a, c, t, g, unknown or other
  misc_feature (414)..(414): n is a, c, g, or t
  modified_base (590)..(590): a, c, t, g, unknown or other
  misc_feature (590)..(590): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactcgaccaaagcaatatggttatggtaccagcagagcagccacgccccttatggtnatatataaggaccagtgagacggcctcgaggactccgtgacgtcgtactttccnggtctccctcctcgaaacgggtaccaacgtaggtacacggttgacttcgatcgaaggttcggacggtcccggggnaaggagggaacgagggtactcggaacttacgtattacggtactaaactacgaaacgaacgacgtaaggttagtaggttaacttagtgttacgcgtacggttcgggaacgggtacgggaaaccgtagccgtacggtaaccgttccgttagggttccgaacggacccgaacgggtccnccggttcccccgttaacgcccgttcccg

SEQ ID NO: 302122 - DNA, 611 bp, Homo sapiens
  misc_feature: GZ8MTXP01DX42Y.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaaatattggttattggtaccagcagacggcacggccgaacggtcccccttagttcggtgtattaatagtaacggaccatgaagacggccctcgaggtactcccgtgacgcgtattcctcgtcggcctcctcctacgacgggaacacacgtacacgtttgactcgatcgagttagggacgccgggacgaggaacgggtacggaggctaggaaccttattacgtagttacgaaacttacgaaacgtaacgaacgtagttaaggttacggttaatttagtgttgacgtaggttcgggacggacgggaaccaagcggtacgaaccgttccgttaggtccacgcccgtaacggcttcccgtccccgttcgtaacccg

SEQ ID NO: 302123 - DNA, 611 bp, Homo sapiens
  misc_feature: GZ8MTXP01CEJCV.52.78.H01.1.454.CMB.2.raw
  modified_base (323)..(323): a, c, t, g, unknown or other
  misc_feature (323)..(323): n is a, c, g, or t
  modified_base (491)..(491): a, c, t, g, unknown or other
  misc_feature (491)..(491): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggtattggtaccagcagacgcagccaggccccttatggngatatataaggacatcgagtacggccctagagggaactcccgtggacgccggtattcgtcgtcgggtccttcccgtcccgtacgaacggggaacctaaacgacgtcgtaacggtttacgactccgaattccgaagttcgggacgttccgggggacaggacgggacggngctggaacttaattaccgtaggtacaactcaaacagaacgtagttagtggtaactttagttcggttagccgtagggttccgggacgggtacgggttacctaacggttccgttaacccggg

SEQ ID NO: 302124 - DNA, 558 bp, Homo sapiens
  misc_feature: GZ8MTXP01DMSET.52.78.H01.1.454.CMB.2.raw
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (473)..(473): a, c, t, g, unknown or other
  misc_feature (473)..(473): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttatgtaccagcagagcaggccagcccctatgngatatataagacatgagngcctgagggactccctgagcgattctctcggctcctccgtcgagggtaaacaaactgtactacgttgactcactcgaggtggacggtcccggggacaagggaggacggaggtcgtagacgtattactgtacaattacaacaagactagagtacggtattatgtgcgtaggtcgggngggtaacgggaaccaggccgttagaccgtcgttaaggttcgaacgcccgaaacggctccggccccttcggtccttaacgttcccc

SEQ ID NO: 302125 - DNA, 573 bp, Homo sapiens
  misc_feature: GZ8MTXP01EZY2A.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggcccacggcccccttattcggtgatatataaggaccatgagacgcccctcgacgggatcccgtgacgcgtattctctggcctcctcctcgagggaccaacagtcacgttgactcaatcgagtggaggtccgggcgaggacggacgggaacggtcgtgtacttagttaacctgttacaaactcaaacgagaaccgtagtaaggtggttacttaagttgtggtcttaagggttcgggacggggaagggaccgaagccgtcgacccgttaaccgttaacggtaacccgg

SEQ ID NO: 302126 - DNA, 591 bp, Homo sapiens
  misc_feature: GZ8MTXP01CF9JU.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtaccagcagagcagcagccccttatgtgatatataaagaccatgagacgcctgaggatccctgagcgtattctctcggtcctctcctcgacggaacaacgtaagtctacgttacgatcactcgagtgacgtccgggacgaggaggacgagtctagactatactgtacaatacaacgaagacaagtagtacggtattagtagtcgtgtacggttcggcgggaacgggaacaaaggtccgttacggtaaccccggttcgttaacggggttccaccggggaacccgtaaaccggggtccttcccgggaccccccgttcgggttaaccccaaccgttttccccgg

SEQ ID NO: 302127 - DNA, 819 bp, Homo sapiens
  misc_feature: GZ8MTXP01B2XVQ.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagacggccaggccacggtcccccttagttcggtagatatataaaggaccatgagacggccctcgaggggactcccgtgacgacgtacttctcgtcgggtccctccctccctacggaacggggaaccaaccgtacgttaccgtaacggtttaggaacttacgtaacgttacccggtaagggttacgggggaaccgggttacccgggggaacgtaaacgggggtaaaccgggggtaaaccggggggaacgggggtacccggtttaacggggtaaacccttttaaacggttttaaacccggttacgggtttaaaccgtaaaaactttaacccgaaaaaccgtaaacgggtaaacccgttaaaggggtttaaagggtttaacggggtttaaacccgttttaacggtttaggggttacggtaccgggttaaacgggggttttcccgggggaaccgggggttaacgggggaaaccccggtaaacgggttacccgggttacgggttaacccccggggttcccggttaaacgggggttaacccccggg

SEQ ID NO: 302128 - DNA, 648 bp, Homo sapiens
  misc_feature: GZ8MTXP01CSC15.52.78.H01.1.454.CMB.2.raw
  modified_base (237)..(237): a, c, t, g, unknown or other
  misc_feature (237)..(237): n is a, c, g, or t
  modified_base (240)..(243): a, c, t, g, unknown or other
  misc_feature (240)..(243): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
tcagcgcagtacgacacgaccggtgctcgatttagtgtgagtagtttgggtttgggctggggagcctagctgtgctgtgggtccaggaggcagaactctgggtgtctcaccatggcctggatccctctacttctcccctctcactctctgcacaggctcgtgggcctcctatgaactgacacacgccacccgtggtgtcagtcgtcctgaggacaggacggcaggatcacctgctgngannnncngacaagntatagtgtatcgacagnagcgacgacgcacgtcctagtganatanagacgacagcgagtcgcctacgagtctcgagacgtactctcgtcgtcgtacctccgtagtacggacgacctactacgtacgtacgtanacgtacgtacgtacgtacggtacggtacggtacggtacggaacggaacggtacggggtacggtacggtacgttaacgttaacgttaacgtaacgtaacgtaaaccgtaacgtaaaccgtaacgtaacgtaacggttaacggttaacggttaacggttaacggttacggtacggtaacggttacgggttacgggttaccgggtaacgggtaaccggtaaccggtaccggtaccggttaccggtaaccggttaaccggtaaccgg

SEQ ID NO: 302129 - DNA, 695 bp, Homo sapiens
  misc_feature: GZ8MTXP01CDSDP.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacgccaggatcacctgctctggagatgcactgaccaaagcaattagtggttattggtaccagcagaggccaggccacggtccccttagtggtgatataataaggaccagtgaagacggccctacgagggactcccgtagacgcgtattcgtcgtccggcctctaccgtcgaacgggaaacaacgtcgtacaaccgttagaacttccagtactaaggttcggacggtaccgggacgaagggacggaccggaggtaccgtagaacgttaacgttacgtaggtaactaaacgttacaaaacgttaaggaacctaaagggttaacggttcggttaaactttagttaggttacgaccggtaacgggttaccgggacggggtaacgggaaaccgttaaacggtcgttaccgggtaacccgtacccgttagggttacccgaaccggtaaccccgaacggtccgtccccggtacccccgttcgggtccccttaaccgtttcccccgg

SEQ ID NO: 302130 - DNA, 714 bp, Homo sapiens
  misc_feature: GZ8MTXP01A0TND.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagacggccaggccacggccccttatcggtgatatataaggaccagtgagacggccctcgaggactccgtgagcgtacttccgtctggcctccctcccgtacgaacgggaacaaacgtacgtacacggttgactacacgtacaggttgggaacggtcccggggacaacgggaacgggaccgggtaagggcttaacggacgtttaaacgtttaccgtacggttaaccaaacgttaaccgaaacgtaacggtaaaccgtaacggtttaaggttaacgggtttaaaccgtttagttacgggttacgtaaccggttagggtttccggggaacggggttaaacggggacccgttaaaagggtcccgtacgggttacccggttccgttacggggttaacccgaccggaacccgtaaacgggcccggttacccgtaaccccccggttcgggttaaccccg

SEQ ID NO: 302131 - DNA, 611 bp, Homo sapiens
  misc_feature: GZ8MTXP01CHOD8.52.78.H01.1.454.CMB.2.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (370)..(370): a, c, t, g, unknown or other
  misc_feature (370)..(370): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatccacctgctcgtggagatgcactgaccaaagcaatntggttattgaccagcagagcagcacgccctatgnatananagacatgagacgcctgaggtactcccgtagacgtcgtatctcgtccggcctctcctcggaaggaaacaacgtcgtctacggttanactaccattcgaaggttcggacgggtacccggacgagggacggacgtaagccgtagtaacttacgtatcgtaacaacttacggaacgagtaacctaggttaagtcggttacttagtacggtgtaccggtaggttcgggacgggaacggaccaaggtccttcggacccgttcggttacgttccgaacggtcccgaacgggtcctccccgggtcccgttacggtcccgttaacggttcccccg

SEQ ID NO: 302132 - DNA, 516 bp, Homo sapiens
  misc_feature: GZ8MTXP01DJCFH.52.78.H01.1.454.CMB.2.raw
  modified_base (348)..(348): a, c, t, g, unknown or other
  misc_feature (348)..(348): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtacagcagagcagcagcccctatgtgatatataaggaccatgagaggccctcagggatccctgagcgattctctcggctcctcctcagggtaacaacngtcacgttgatcatcagtggagtccggcagaggacgaggctgactattactgtacaatcaacagacagtagtgtacttatgtgcgtagttcggcggaagggcaaaggcttagaccgtcgttacggttcacggcccgaaggctacgcccccttcggtccaacgttcccg

SEQ ID NO: 302133 - DNA, 659 bp, Homo sapiens
  misc_feature: GZ8MTXP01DD24K.52.78.H01.1.454.CMB.2.raw
  modified_base (287)..(287): a, c, t, g, unknown or other
  misc_feature (287)..(287): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagagccaggccacggccccttatggngatatataaggaccatgagaggccctagaggactcccgtgacgtcgactttccctcgtcggtcctccctccgtacgaagggaaccaaacacggttacctaacggttagaacttcgaactcgtaggttagggacggtccgggacgaaggaacgggaccgaaggggtcctaggtaacttattaccgtaggtacgaaacttaccgaaacgaagtaccgtaaagttggttaggttaacttaagtggttacgaccgtagggttcgggacgggttaaggggaacccaaagggtcctcgggttaacccgttccgttacgggttaaccacccggaacccgaaacggtcccgttaccggtccccccgttcgggttaacccc

SEQ ID NO: 302134 - DNA, 533 bp, Homo sapiens
  misc_feature: GZ8MTXP01C2Y91.52.78.H01.1.454.CMB.2.raw
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggcccccttattggtgatatataaggaccatgagaggccctcgaggactcctgagcgattcctctggctcctcctcgagggaacaacagtacacgttgatcatcagtggagtcggcagaggacgagctgactattacncgtanaatcgaacagacgtagtagtggtaacttgtgtgctaggttcggcgggaggtaccgaagcgtcggacccgttcgttaacggtcgacgcccgtaaggccttccgccccgttcgtaaccg

SEQ ID NO: 302135 - DNA, 687 bp, Homo sapiens
  misc_feature: GZ8MTXP01B6TII.52.78.H01.1.454.CMB.2.raw
  modified_base (220)..(220): a, c, t, g, unknown or other
  misc_feature (220)..(220): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcggtggtttcgtgtaggctatttagaaggtgtcagtgtgaggcgcagcgtggtggagtcgtgggggnggtgttcggtcgacgccggtcgggggtccgtcgacactctcgtgtgtacgtctcgtgtactactaccttaactagttagtagtagtgtacgttcggtccgccgacggtcgtacggacggggaaggggtcggtagggtagggtggggtcggtcgtacggtacggtaggaagtacgtagtaggtaggtagggtagggtaggaaggaagtaaacgtagtcggtacggtacgtacgtggtacgggacgggtaccgtactacctacctaccgtacgaacgaacgaacaaactaactaacgtaaacgtaaactaactaacgtacgttaacttaccgtaactaaagtaacgaacgacgtacgtacgtacgacgacgtaccggacggaaccgaccggtaacgtacgttacgttacgttcgtagtagttaggttcggttggttggttgttggttcggttcggttcgtcgttcgtcg

SEQ ID NO: 302136 - DNA, 601 bp, Homo sapiens
  misc_feature: GZ8MTXP01BEY3P.52.78.H01.1.454.CMB.2.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (553)..(553): a, c, t, g, unknown or other
  misc_feature (553)..(553): n is a, c, g, or t
  modified_base (589)..(589): a, c, t, g, unknown or other
  misc_feature (589)..(589): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaagtgtccagtgtgaggcgcagcgtggtggagtcgtgggggagcttggtccagccgtgggggtccctgacnctctcctgtgtagcctntggattcaacctttaacagttattggatggtacgttgggtcccgccgaggcctaccgaggggaaggggctgggaggtgggtggcccaggcgtagaagcagtgagtgggaggtaggaaggaagaactagtcggacgggacttcgtggtaggaacggggtcctagttcccacctaccttacagaacgaacaacatacaaagaactacgaatagtactcgtaacaaagtcgagcaacgcctagaccacgtcccggaggaccgcggccgttagttattacgttggtcgngttaggttgttcgtttgggatttggttgtcgttacncgttaaccgtcg

SEQ ID NO: 302137 - DNA, 509 bp, Homo sapiens
  misc_feature: GZ8MTXP01AB8L4.52.78.H01.1.454.CMB.2.raw
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttatggtaccagcagngcagcagcccctatgtgatatataaggaccatgagaggccctgagggactccctgagcgattctctcggctcctcctcgaggaacaacngtcacgttgatcatcagtgagtccggnagngacggngcngatatntnacanacganaganagtagtgtatagtgtgtgtacgtcggcggaacggacgacgacgcgtacgtcgttacgttcgacgaaccgacgccgccgtcccgttccgtccgttcgtccg

SEQ ID NO: 302138 - DNA, 574 bp, Homo sapiens
  misc_feature: GZ8MTXP01BC7VM.52.78.H01.1.454.CMB.2.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatattggttattggtaccagcagaggccaggccacggccccttagttcggtnatatataacggaccatgagacggccctacgagggactcccgtgacgcgtacttcctcgtcggtcctccttccctaacgacgggaacaacgacgtacctacgttgactcatcgaggtcggacggtccgggacaggacgggacgaggctagactattacgtgtacgaactacaacagacaggtagtggttactatggtagcgtaggtcgggcgggacggacgagtcgtacgccgttcgttacggcgacgccgaacggcttacccgtcccgttcggtaacccc

SEQ ID NO: 302139 - DNA, 588 bp, Homo sapiens
  misc_feature: GZ8MTXP01A3RWA.52.78.H01.1.454.CMB.2.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (294)..(295): a, c, t, g, unknown or other
  misc_feature (294)..(295): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctctcactctctgcacaggctctgggcctcctatgaactgacacagccacctcggtgtcagtgtcctnagacagacggccaggatcacctgctctgagatgcatgcaaagcanatgtatggacngcagagcaggccagccctatgngatnatagcnngangcctgaggtancctgagcgtatctctggacctccgttcacacgggacacgagtactaacgttgaacttcgaactcgttacggtaaggtcgggtaacccggggacggaagggtacgggacggggtacggtacgtacggtaacttaacgttaccgtacgtacctaaactaacgtaacgtaacgacgtaaggtaaggttacggttacgttagttaggtacgtcgttacggttcgggttacgggtaacgggacggaacgtacgtacggttaccggtaaccgttaacggtaaccg

SEQ ID NO: 302140 - DNA, 514 bp, Homo sapiens
  misc_feature: GZ8MTXP01COZBB.52.78.H01.1.454.CMB.2.raw
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (480)..(480): a, c, t, g, unknown or other
  misc_feature (480)..(480): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagccaggccaggcccccttatggnatatataaggacatgagacgcctnaggactccctgagcgattcnctggctcctcctcgagggacaacacgtcacgttgatcatcagtgagtccgggnaggagacgagctagactagtctgtnaatcaacagacagttgtagtacttagttgttgngtaggttcgggacggaggaccgaagcgtaaccgg

SEQ ID NO: 302141 - DNA, 671 bp, Homo sapiens
  misc_feature: GZ8MTXP01BZRH2.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatattggttattggtaccagcagacgcaggccacggccccttatcggtgatatataagaccatgagacggccctgaggactccgtgacgcgtacttccctcgtggcctccctccgtacgaacgggaaccaaactagtacctacgttagactcactacgtaggtcgggaacggtccggggacaagggaacgggaacggagggtaccgtaggtaacttaacgttaacgttaggtaacgtaaacttaccgaaacctaaggtaaaccgtaagttaaccgggttaggttaaacctttagtagggttacgtcgtaacgggtttcggggaacccggggttaagggaacccgaaggtccgtaggttaccccgttccgagggttaaccgacggaacccgttaacggccgttacccgtcccccgttcgggttaaccccg

SEQ ID NO: 302142 - DNA, 543 bp, Homo sapiens
  misc_feature: GZ8MTXP01C9NAM.52.78.H01.1.454.CMB.2.raw
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaaggaccatgagaggccctcagggatccctgagcgattctctggctctctcagggaacaacngtcacgttgatcatcagtgagtccgggcagaggacgaggctgactattactgtacaatcaaacngaacagtagtggtacttagtagtgtgtaggttcggacgggaagggaccgaaaggcgttggacccggttcgttaaggttcgacgcccgaaggccgtccgccccgttcggtccaacgtttccccg

SEQ ID NO: 302143 - DNA, 625 bp, Homo sapiens
  misc_feature: GZ8MTXP01B1CF6.52.78.H01.1.454.CMB.2.raw
  modified_base (365)..(365): a, c, t, g, unknown or other
  misc_feature (365)..(365): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggcacggccccttatggtgatatataaaggaccagtgagacggccctcgagggactccctgagcgtattctctcggcctctcctcgacgggaaacaacncgtcacgttgatcatacgaagttggacggtccgggacgaggacggacggaggcgtagacgttattactgtactaactacaaacgagaacgaggttagtggttaacttagttacgtgtacgttaacgggttcgggacggggaacgggaacccgttaaggaccgttacggtaacccggtccgttaacggttccgaacccgtaaccccggaaacgggtcccgtcccggtccccccgttcgggtaacccgttcctttcccccgg

SEQ ID NO: 302144 - DNA, 646 bp, Homo sapiens
  misc_feature: GZ8MTXP01CP36D.52.78.H01.1.454.CMB.2.raw
  modified_base (311)..(311): a, c, t, g, unknown or other
  misc_feature (311)..(311): n is a, c, g, or t
  modified_base (596)..(596): a, c, t, g, unknown or other
  misc_feature (596)..(596): n is a, c, g, or t
  modified_base (623)..(623): a, c, t, g, unknown or other
  misc_feature (623)..(623): n is a, c, g, or t
  modified_base (637)..(637): a, c, t, g, unknown or other
  misc_feature (637)..(637): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggtttcctgttgctatttagaaggtgtccagtgtgaggcgcagctggtggagtcgtgggggagcttggtccagccgtggggggtccctgacactctcctgtgtacgcctcgtggacttcctacctttaacagtttattggatgacgttgggcccncaggctccgaggggagggctggagtggggtcgccaggcgtagaagcagtgagtggggagtggaaggaagactagtcgacggtctcgtggtacggaacggggtcctattcccaaccgtaccgttaccgaagggaaacgaaaccaaactaactacaaaacggtaacctaacttaaaagttgttaaacctaccttaaacccgaaaagttaccgaaggaccaaacggttcccagtaaacccacggtacccggaagtacccgaacgggtcccgttaagttacgtttacgnggtagcgttagtttgtttggttaaggntttgttcggtcgcnccgaacgtg

SEQ ID NO: 302145 - DNA, 509 bp, Homo sapiens
  misc_feature: GZ8MTXP01BSYKK.52.78.H01.1.454.CMB.2.raw
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (492)..(492): a, c, t, g, unknown or other
  misc_feature (492)..(492): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccaggcccctatggtgatatataaggacntaaaagngaggccctnaggatccctgagcgattcctctggctcctcctacgagggaacaacagtcacgttgatcatcaggtggaggtccggcaggaggacgaggctagactatactgacgaatacaacagacagtagtgtactatgtncgngtcggnggaggacagctgaccgttcgttagtcacgccgaggcnccgtccccgttcggtcc

SEQ ID NO: 302146 - DNA, 648 bp, Homo sapiens
  misc_feature: GZ8MTXP01C03PS.52.78.H01.1.454.CMB.2.raw
  modified_base (576)..(576): a, c, t, g, unknown or other
  misc_feature (576)..(576): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctggtggagtcgtgggggagcttggtccagccgtgggggtccctgacactctcctgtgtagcctctggattcacctttaacagttatggatgacgttgggcccgcaggcctccgaggggaaggggctgggaggtggggtcgccaggcgtgaagcatgacgtgggagtggaaggaagtaactaagtggacgtactcgtaggtaggaacggggccgtaattccgacctacttaccgaaggaacgaaacaaacaactacaaagaaaccttacaaattagtaacttactaaaccaaagtacgaacgcacgccctagaaacctcgtaccgaacggaccgaccgggtaacccgttagttacgttacgttggttaccggngttaacggttgttttaccggtttaagggtagtttgggttttcgttcggtttacgaacccgttaacgtcccgg

SEQ ID NO: 302147 - DNA, 527 bp, Homo sapiens
  misc_feature: GZ8MTXP01A1G4M.52.78.H01.1.454.CMB.2.raw
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggccctgagggatccctgagcgattctctcggctcctcctcgacgggaacaacngtcacgttgatcatcagtgagtcggnagnggacgagctgactattactgtacaatcaacagacagtagtgtacttagtgtgngtagttcgggnggaagggacagcgttcgaccgtcgttaggttcacggcccgaaggtcctccgccccgttcggtccaacgttcccg

SEQ ID NO: 302148 - DNA, 617 bp, Homo sapiens
  misc_feature: GZ8MTXP01BKYHU.52.78.H01.1.454.CMB.2.raw
  modified_base (265)..(265): a, c, t, g, unknown or other
  misc_feature (265)..(265): n is a, c, g, or t
  modified_base (464)..(464): a, c, t, g, unknown or other
  misc_feature (464)..(464): n is a, c, g, or t
  modified_base (492)..(492): a, c, t, g, unknown or other
  misc_feature (492)..(492): n is a, c, g, or t
  modified_base (587)..(587): a, c, t, g, unknown or other
  misc_feature (587)..(587): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacactctcctgtgtancctctggattcacctttaacagttattggatgacgttgggtcccgcaggctccgagggaaggggctggagtgggtggccagcgtgaagcatgagtgggaggtgaaggaagaactagtcggacggtacttcgtaggtagaaacggggccgtaattccacctaccttaccaaggacgaaccaaacatacaaagtaacctanaattcgtaactcgtaacaaagtcggaancaacgcccttgaaacctacgtacccggaaggacccacggggtccctaggtttaacttaccgttggtacgcggttagttcgtttcgttaaggggtntttggttcgttcgttcgtaaccgaacgtcg

SEQ ID NO: 302149 - DNA, 627 bp, Homo sapiens
  misc_feature: GZ8MTXP01BXQMM.52.78.H01.1.454.CMB.2.raw
  modified_base (397)..(397): a, c, t, g, unknown or other
  misc_feature (397)..(397): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctggagatgcactgaccaaagcaatattggtattggtaccagcagagccaggccacggccccttatggtagatatataaggaccatgagcggccctagacgggtactcccgtgacgcgtactttcctcgtggccctccctacctaccgaagggaaccaaacgtagtaccgtacggtttanactcatacgtagtacggtacggtcggacgagggaggacggaggtacgtagtaacttacttacgtacgtacgtaaactacgaaacaaggtaacgtaggttaaggttagttaacgttagtaggtacgtacggtaggtaacgggacgggacggaaccgaggtccgtacggttacccgttcgttacggtaacgaccggaaccgaacggtcccgttaccgtccccgttcggtccg

SEQ ID NO: 302150 - DNA, 607 bp, Homo sapiens
  misc_feature: GZ8MTXP01ESEQW.52.78.H01.1.454.CMB.2.raw
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtcccctgacnctctcctgtgtagcctntggattctacctttaacagttatggatgacgttgggtcccgcaggctccgaggggaggggctggaggtggggtggcccagcggtgaagcatgagtgggaggtgaaggaagaactagtggcggactcgtgtagggagggcctattcacctactaccagacgaacaacatacaaagaactacaagtactactactacaaagtcgaagcacgacgtagaacctacgtaccggacggaccgaccgggtcgttacgttacgttaccgttggtacgtcggttaggttacgtttcggtttggggtagtttgggtttcggttcggtttcgccgttaaccgtccgg

SEQ ID NO: 302151 - DNA, 675 bp, Homo sapiens
  misc_feature: GZ8MTXP01A5UQX.52.78.H01.1.454.CMB.2.raw
  modified_base (210)..(210): a, c, t, g, unknown or other
  misc_feature (210)..(210): n is a, c, g, or t
  modified_base (415)..(415): a, c, t, g, unknown or other
  misc_feature (415)..(415): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggntcacctgctctggagatgcactgaccaaagcaatatggttattggtaccagcagaggcaggccaggtccccttatggtctatatataaggaccagtagagacggccctcgagggactcccgtgacgcgtattcctcgtggctcccgtcctacgagggtaacaaacgacgtcacgttgactacgtatccgaagtggacggtccggngagacggacgaggcgtagtacgttaagttactacggttacgaaacttaccgaaacgtacgaaccgtaagtacggttacgggttaactttagtaggttacgtaccgtaggggtttaaccgggacggggacggggtaaacccgaaacgggtacccgttacgggttaaaccccgtttccggtttacgggtaaccccgtacggtaacccccggaaacgggtcccgttaaccccgggtcccccgtttccgggggtttaacccccg

SEQ ID NO: 302152 - DNA, 582 bp, Homo sapiens
  misc_feature: GZ8MTXP01DSXY1.52.78.H01.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (449)..(449): a, c, t, g, unknown or other
  misc_feature (449)..(449): n is a, c, g, or t
tcagcgcagtacgacacgaccggtgctcgatttagtgtgagtagtttgggtttggggaggtctcggagaggagccttagccctggactccaaggcctttccacttggtgatcagctactgagcacagaggactcaccatggagttgggctgagctgggttttccttgttgctattttagaaggtgtccagtgtgaggcgcagcgtggtggagtcgtgggggaggcttggtccagccgtggggggtccctgacactctcctgtgtagcctgtggattcactttaacngttatggatgacttggtccncaggctccgaggagggctggagtgggtgccaggcgtagaagcagtgagtgggaggtgaaggaagaactatggcggtactcgtggtaggaacggggcctaagttccacctacttccgaagagaacaaacatacaaagaacctanaatgtactcgtacaaagtgagtcaagcctagaactcgtacccggaaggaccgccggtaaccgtgttaaacttcgttgtacggcgttaaaggttggtttcgttggggtattggtttgtcgttgcccaacgtccg

SEQ ID NO: 302153 - DNA, 651 bp, Homo sapiens
  misc_feature: GZ8MTXP01DWFYS.52.78.H01.1.454.CMB.2.raw
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
tcagcgcagtacgacacgaccggtgctcgatttagtgtgagtagtttgggtttgggggtgggtccaggagtcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccacggccccttattggtnatatataaaggaccagtgagacggccctacgagggacttcccgtgagcgtagttctcgtcggcctcctcctcgacggtaaaccaacngtcacgttagatcatcgagttggacggtccgggacgaaggacggaacgagggtactgtaacgttacgttaccgttgtaactaacgttacaaaccgtaaggaaaccgtaaggttaagttaggggttactttaagttggttcgtacgtacgggtttaccgggacggggaacgggaaccgaaaggtcgttacggtaacccgttccgttacgggttaccgaccggaaccccgaaagggtcctacccggtcccccggttcggtcccgttaaccgtttccccg

SEQ ID NO: 302154 - DNA, 776 bp, Homo sapiens
  misc_feature: GZ8MTXP01AIRYA.52.78.H01.1.454.CMB.2.raw
  modified_base (370)..(370): a, c, t, g, unknown or other
  misc_feature (370)..(370): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctggtggagtcgtgggggagcgttggtccgagccgtgggggtccctgacactctcctgtgtacgcctctggattccacctttaacagttattgagtgtacgttggtccggcctacggctccgagggaaggggcgtggaggtgggtggccaggcgtggagcagtgagngggaggtggaggaagaaacctgtggcgggtaacgtcgtcggtagggaacggggaccggtactttaccaacccacccgtttaccgaaacgaggaaacccgaaaccgaaacgtttaacaaaaaccggtaaaccttaaccggtaaaagttcgtttaaaccgttaccgtaaaccccctaaaaaagttacggacggaaaccgaaccgtccccgttaacggaaacccttaaccggtaaccccgggtaaacggggtaaccccgaaccccgggggttaaccccggttaacggtttaagttttaacccgttcgggttagggtacccggttagggttaacggttttaccgggttttgggggtaaagtttggttttacgggtttccgtttcgggtaacccaacccggttaacccggg

SEQ ID NO: 302155 - DNA, 537 bp, Homo sapiens
  misc_feature: GZ8MTXP01D8QFC.52.78.H01.1.454.CMB.2.raw
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (467)..(467): a, c, t, g, unknown or other
  misc_feature (467)..(467): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtacagcagaggccaggccaggcccccttattggtnatatataaaggaccatgagaggccctnagggactcccgtgagcgattctcgtcggcctcctcctcgagggaaccaacngtcacgttgatcatcgagtggagtccgggcaggaggacggaggctagactagttactgtacaatcgaaacagactagtagtgtacttagtgtgctaggttcggngggtaagggcaagcgttagaccgtcgttaggttcacgcccaggcctcgccccgttcggtccttcgttccc

SEQ ID NO: 302156 - DNA, 558 bp, Homo sapiens
  misc_feature: GZ8MTXP01BF0KW.52.78.H01.1.454.CMB.2.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtacagcagagcagccaggccctatgtnatatatagacatgagnggcctgaggactcctgagcgattctctcgctctcctcgacggaacaacngtcacgttgatcatcagtggacgtccgggacaggagggacgaggctagacgttattacgtnactaatacaaanaacgactaggtagtacggttattaagtgtagtcgtagggttcggngggaacgggaacaaaggtcacggtacccgtcgttacggttcgaccggtaaccctaacgggccttcccggcccccgttcggtaaccttcgtttccccgg

SEQ ID NO: 302157 - DNA, 563 bp, Homo sapiens
  misc_feature: GZ8MTXP01ALRI6.52.78.H01.1.454.CMB.2.raw
  modified_base (225)..(225): a, c, t, g, unknown or other
  misc_feature (225)..(225): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtaccagcagaggccaggccaggcccccttatggtgatatataaggaccatgagacggccctcgagggactccctgacgcgattcctctggcctcctcctcgacgggcaacagtcacgtgatcatcagtggagtccgggcaggaggacgagggctaggactaagttactgtacgaatcaacagacagtagtggtacttagtgtagctaggttcggacgggacgggacccaaggtccgtcgacccggttccgttagggttccacggtaacccgaacggccgttaccggtcccccgttcgggttaaccccg

SEQ ID NO: 302158 - DNA, 591 bp, Homo sapiens
  misc_feature: GZ8MTXP01B66FZ.52.78.H01.1.454.CMB.2.raw
  modified_base (505)..(505): a, c, t, g, unknown or other
  misc_feature (505)..(505): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggagcttggtccagccgtgggggtccctgacactctcctgtgtacgcctctggattcacctttaacagttatggatgacgttggccgcaggctccgagggagggctggagtgggtgccagcgtagaagcatgagtgggaggtgaacggaagaactagtcggacggtactcgtaggtaggaacggggcctattcccaacctacttccgaagaacaacaaacagtacaaagacctagaatgtaactcgtaacaaagtgacgcacgcctagacacgtaccggagaaccncgggccttagttacttacgttcggtagacgttagttaggttttcgttaaggggtatttcggttgtcgttacgccgttcgtaaccgg

SEQ ID NO: 302159 - DNA, 540 bp, Homo sapiens
  misc_feature: GZ8MTXP01DO9CW.52.78.H01.1.454.CMB.2.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (344)..(344): a, c, t, g, unknown or other
  misc_feature (344)..(344): n is a, c, g, or t
  modified_base (448)..(448): a, c, t, g, unknown or other
  misc_feature (448)..(448): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagcaatatggttattgtacagcagagcagcaggccctatgnatatanaagcatgagaggcctgaggactcctgagcgtattcnctcggctcctctcgacggaacaacngtctacgtagatcatcagtgacgtccgggcaggaggacgaggctagactagttactgtaacatacaacagaacagtagtcgtattagtgtgtcgtaggttcggnggggaacggaccgaagtcgttacggtacccgtcgttacggttcaccggtaacccgaaggtccctccggaccccgttcggtccaaccttcccg

SEQ ID NO: 302160 - DNA, 561 bp, Homo sapiens
  misc_feature: GZ8MTXP01BH8O2.52.78.H01.1.454.CMB.2.raw
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
  modified_base (531)..(531): a, c, t, g, unknown or other
  misc_feature (531)..(531): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggcttggtccagccgtgggggtccctgacactctcctgtgtagcctctggattctacctttaacagttattggatgacgttgggtcccgccaggcctccgaggggaggggctgggagtgggtgccagcgtagagcatgagtgggaggtgaggaagactatggcgactcgtgtaggagggcctattccaaccacttaccagaacgaacaaaccatacaaagaactacaagtntactctacaaagtgancagcctgacacgtcgagacgcggcttgacttacgttggcgtcgaagttcggttgtttgggnttggtttgtccggttgcccgttaacgtccg

SEQ ID NO: 302161 - DNA, 561 bp, Homo sapiens
  misc_feature: GZ8MTXP01B0GYT.52.78.H01.1.454.CMB.2.raw
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (410)..(410): a, c, t, g, unknown or other
  misc_feature (410)..(410): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcatgacaaagcaatntgtatggtacagcagagcaggccagccccttatggtgatatataagacatgagacggcctcaggactcccgngagcgtattccctctcggctcctcccgtaacaacgggcaaacgacgtacacgtttagactacactcgaggtggacggtcgggacaggaggacggnggacgtagactaattactgtacaaatacaactaagactagtagtacggttattaagtgtagcgtaggttcggacgggttacggaccaagtctacggttaccgttcgttacggtcaacgccgaacggccgttaccgccccgttaacgtcccg

SEQ ID NO: 302162 - DNA, 743 bp, Homo sapiens
  misc_feature: GZ8MTXP01BIJR9.52.78.H01.1.454.CMB.2.raw
  modified_base (710)..(710): a, c, t, g, unknown or other
  misc_feature (710)..(710): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagtcttgggttttccttgttgcttattttagaaggtgtccagtgtgaggcgcagcgtgggtggagtcggtgggggaggtcgttgggtccgaggccggttcgggggggtcccctggacctaccgttcctccgttggtcgtacgtccttcgtgggtactttcctaacccttttaaacgagtttagttggaatcgtacgtttcgggtcccgccgaggcctccggaaggggaacgggggcgtgggaggtgggggtcggcccgaggtcggtagaaagcagtgagtgggaggtggaacggaagtaactaagtcgggcggtaacttcgtagggtagggaaacggggtcccgtaaactttcccaaccgtaaccttaccgaaggaacgaaactaaaccgaattaacaaaacggtaaccctactaaattacgttaactacttaaccaaaagttcgacggacacggtccctaaggaacctacggtaccgaacgggtaccaccgggtccgttaagttacgtttaaccgttgggtaccggtacgttaagggttcgttttcggttaaggggtntttggtttcggtcgttcggaaccaaccgtccgg

SEQ ID NO: 302163 - DNA, 532 bp, Homo sapiens
  misc_feature: GZ8MTXP01AVIQM.52.78.H01.1.454.CMB.2.raw
  modified_base (365)..(365): a, c, t, g, unknown or other
  misc_feature (365)..(365): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtctgggggagcttggtccagcctggggggtccctgacactctcctgtgtagcctctggattcacctttaacagttatggatgacttgggtccgcaggctccgagggaaggggctggagtgggtgcccagcgtgaagcatgatggaggtgaggaanactaatggcggactcgtgtgaacggggcattcaccacttccgagacgacaaacataccaaagaacttacaagtntancgtaccaaagtggaacncgagctagacacgtccgagacgcggtcgtgttatcgngtgtcgagttgttgttggnttgtgtcgngccncgtg

SEQ ID NO: 302164 - DNA, 624 bp, Homo sapiens
  misc_feature: GZ8MTXP01AJ6ZE.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccaggcccccttagtcggtgatatataaggaccatgagacgggccctacgacgggactcccgtgacgacgattcctctggcctccctcgtaaccgacgggaacaacacggtcacgttgatctatcgtagtaggtacggtccggggcagggacggacgacggctaggaccttatacgtgtacgtaactacaacgacgaacgtaggttacggtaggttaacctttagtaggttcgcgtaacgggtttcgggaccgggaaacgggacccgaaaggtccgtcgggttacccgttccgttaacgggtccgaccggaacccgaacggggccttacccggtcccccgttcgggttccccg

SEQ ID NO: 302165 - DNA, 768 bp, Homo sapiens
  misc_feature: GZ8MTXP01C12BH.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccaggccgtggggggtcccctgacactctcctgtgtagcctctggattcacctttaacagttattggatgacgttgggtcccgcaggctccgagggaagggggctaggaggtggggtggccctaggcgtagaagcagtgacgtggggaggtgaaggaaagaactaagtcggacggtactcgtagggtacggaaacggggccgtaactttaccgaccctaaccgtttacccgaagaaacggaacaaaaacctaaagtaaaaacgtaaaccctaacaaaagttacggttaaacttacccttaaacccgtaaaaaacgttggtaaaaccgaccggaaaccgggtttaacccctaggaaaccgttaaaccggtacccgggtaaaccgggaaacccgacccggggtcccgggtttaacgtttaaacgtttaaccggttggttacgggtaccggtaaggtttaccggtttttcgggtttaggggttaagtttgggtttccggtttacgggtttcggaccctaacccggttaaggtttcccccgg

SEQ ID NO: 302166 - DNA, 619 bp, Homo sapiens
  misc_feature: GZ8MTXP01D21TE.52.78.H01.1.454.CMB.2.raw
  modified_base (467)..(467): a, c, t, g, unknown or other
  misc_feature (467)..(467): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatagtaggttattggtaccagacaggacggccgaggccgacggtcccccttaagttggtagtaattaataagtaaacgggacctaagtggaacggacggaccccgtcgaacgggtacctcccgtaggagcgtattctcgtcggcctcctccgtcgacgggtaaaccaactcgtacacgttagactcatctagggtgacggtccggagaggacgggagaggctgaactntactgtaatactacaaacaggtaactaggttagtggttacttagtgtgtcgtacggtcggacgggaaggaccaggccgttacgacgttccgaggttccgaacgcccggaaggtcctcccggtcccgttaccggtccttaacccgtttccccg

SEQ ID NO: 302167 - DNA, 555 bp, Homo sapiens
  misc_feature: GZ8MTXP01AJ3WZ.52.78.H01.1.454.CMB.2.raw
  modified_base (285)..(285): a, c, t, g, unknown or other
  misc_feature (285)..(285): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggcaggccaggtcccctatgnatatataaggaccatgagacggccctagagggtacttcccgagagtcgtatttcccctctggcctccctcctacgacgggaacaacagtcactattgatacatcaggtggacgtcgggnagaggagaggctagtactattacgnggtacaagtcaaacgtagaacgtaagtagtaggttaacttagtgtgcgtaaggttcggacgggaagggaccgtaaagcgttacgccgttacgtaagggcaacgcccgagcccgtcgcccccgtcgg

SEQ ID NO: 302168 - DNA, 747 bp, Homo sapiens
  misc_feature: GZ8MTXP01BXX8I.52.78.H01.1.454.CMB.2.raw
  modified_base (241)..(241): a, c, t, g, unknown or other
  misc_feature (241)..(241): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctctcactctctgcacaggctctgggcctcctatgaactgacacagcccaccctcggtgtcagtgtcctcaggacagacggccaggatcacctgctctgganatgcactgaccaaagcaatagtaggtattggtacagacgaggacggccacggcccacggtacccccttaagttcggtagtatataagttaaacggacctagtcggaagacggccccgtccggggactcccgtggacgcgtaacgtttctcgttcgggtcccttcccgtcccttaccggaacggggaaccaaactaacgggtcctaacggtttacgacgttacctaagtaccggtaaaggtcggggtacggtccgggaccgaagggaacggggtaaccgggaggggtacgttacgggtaacgttaactttacgtacggttaccgaaattaacctaaacgtaaaccggaacgtaacggtttaaagggttaaccggttaaacgttttaagttcggggtttaagcccggttaaagggggttttcccggggacgggggaaccggggtaacccgaaacgggtcccgtttacggggaaccccgttcggttaacgggttaaccgtaaacccggg

SEQ ID NO: 302169 - DNA, 574 bp, Homo sapiens
  misc_feature: GZ8MTXP01BVCDL.52.78.H01.1.454.CMB.2.raw
  modified_base (378)..(378): a, c, t, g, unknown or other
  misc_feature (378)..(378): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagacggccaggccacggcccccttagtcggtgtatataataacggaccagtcgaggacggccctcgagggactcccgngacgcgtattctctcggctccctctcgacgggtacaacgagtcacgttgactcatcaggtacggacggtccgggggcagggacggacggaggctcggtacttacttacgtcgttacaaacgtcaaacgagttaacagttacgtaggtacttagttggttgcgtaggtcggcgggacggaccgtaacgcgtaaccgg

SEQ ID NO: 302170 - DNA, 520 bp, Homo sapiens
  misc_feature: GZ8MTXP01CCDH3.52.78.H01.1.454.CMB.2.raw
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgtatggtacagcagagcaggccaggccccttatggtgatatataaggacatgagacggccctgaggactcccgtgagcgatttcctcgtggtcctccctccgtacgagggcaaacagtcacgttgatcatcagtggagtccggnagaggacgaggcgtgactattaccgtgtacaatcaaacagacgtagttagtggtacttagtgtgcgtaggttcgggaggagggaccaaggctgaccgttcaggtcacgcccagcttcgtccccgttgtcc

SEQ ID NO: 302171 - DNA, 747 bp, Homo sapiens
  misc_feature: GZ8MTXP01DA3S3.52.78.H01.1.454.CMB.2.raw
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtacagcagagcagcacgccctatgnatatataagacatgagagcctagaggactcccgngagcgtattctctcggcctcctccgtacgacggggaaaccaaacgtcgtactaccggtttagaactctaacgttacgaagggttagggtaaccgggttccccggggacgaaggggaacggggaaaccgggaaggggtaccgttaagggtaacccgtttaaagtttaaaccttaggttaaccctaaaacggttaccaaaaacccggaaggtaaaaccgttaaagggttaaggtttaaaccgggttaacttttaagggttacggttaggtaccggttaacgggtttaccgggggtaaccggggtaaacggggtaacccgaaacgggtccgttaccgggtaacccgttaccggttaacggggttccaaaccggtaaccccggaaaacggtcccggttaccccgcccccggttccggttaacccgttaaccgtttccccgg

SEQ ID NO: 302172 - DNA, 602 bp, Homo sapiens
  misc_feature: GZ8MTXP01CHE8Z.52.78.H01.1.454.CMB.2.raw
  modified_base (366)..(366): a, c, t, g, unknown or other
  misc_feature (366)..(366): n is a, c, g, or t
  modified_base (594)..(594): a, c, t, g, unknown or other
  misc_feature (594)..(594): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggtcctcctatgaactgacacagccaccctcggtgtcagtgtcctcaggacagacggccaggatcacctgctctggagatgcactgaccaaagctaaatatggttattcgtacagcagaggccaggccacggccccttatggtgatatataaggaccatgagacgcctcgaggactcccgtgagcgtattctcgtcggcctcctcctcgacggaaacaacgngtactacgttgactcgatcgaggtaggacggtccgggacgagggaacgggacggaaggtcgtacggtaaccttagttaactacggtactaaacttacgaaacgtaacgtaacgtaaggttagttacggttacttaagtggtgtacgtacggttcgggacgggtaacggaaccgaggtcgttcgaccgtcgttacggttcacgccgagtcctccgccccgttacgtccncgttcccg

SEQ ID NO: 302173 - DNA, 543 bp, Homo sapiens
  misc_feature: GZ8MTXP01D9FYM.52.78.H01.1.454.CMB.2.raw
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtaccagcagagcaggccagccccttatgtgatatataaggacatgagacggcctcgagggactcccgtgagcgtacttcctctggcctccctcctaccgaagggaaccaaacgacgtacgtacgttgactacattcgagttggacgtcgggcaggaggacgaggcgtagactagtactgtacaatacgaanagactagtagtgtaattagtgtgctggtcggacggaggaccaagcgtcgaccgttcgttacgcacgccacgggtccaccgtccccgcggttaaccc

SEQ ID NO: 302174 - DNA, 545 bp, Homo sapiens
  misc_feature: GZ8MTXP01BDBY4.52.78.H01.1.454.CMB.2.raw
  modified_base (287)..(287): a, c, t, g, unknown or other
  misc_feature (287)..(287): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (524)..(524): a, c, t, g, unknown or other
  misc_feature (524)..(524): n is a, c, g, or t
  modified_base (544)..(544): a, c, t, g, unknown or other
  misc_feature (544)..(544): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggtttccttgttgctattttagaaggtgtccagtgtgaggcgcagctggtggagtcgtgggggaggcttgggtccaggcctggggggtcccctgacactctcctgtgtagcctctggattcacctttaacngttatggatgacttgggtccgcaggctccgagggaaggggctggagtgggtgccagcgtgaagcatgatggagtgaggagaactatgcggactctgtgagggcgattcacctactccagacgacaaaccgatacaaagaactcaattagatcctacaaatgaagcaagccctgaccagtcccgaggaccacgggcctgttactacgngtcgcgttaaggngttttcttaagggggtnttggttgtcgttgccttcgng

SEQ ID NO: 302175 - DNA, 589 bp, Homo sapiens
  misc_feature: GZ8MTXP01DX2CL.52.78.H01.1.454.CMB.2.raw
  modified_base (225)..(225): a, c, t, g, unknown or other
  misc_feature (225)..(225): n is a, c, g, or t
  modified_base (487)..(487): a, c, t, g, unknown or other
  misc_feature (487)..(487): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcatgaccaaagcaatatgttatgtaccagcagagcaggccagcccctatgtgatatataaggacatagagacggccctgagggactcccgtagacgcgtacttcctcgtggcctccctccgtacgaacgggaacaactagtcctacgtgactcactcgagtggacgtccgggacaaggtacgggacgaggacgtagtaactattaactgttaacgaacttacgaaaccagaactagtagttaggtaactttagtgtcgngtacggttcggacgggacggaccaaaggtccgtacggttacccgttcgttacggaaccaccggtcccgaacggcccgttcccgcccccgttcggtaaccccg

SEQ ID NO: 302176 - DNA, 564 bp, Homo sapiens
  misc_feature: GZ8MTXP01AE4YZ.52.78.H01.1.454.CMB.2.raw
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (437)..(437): a, c, t, g, unknown or other
  misc_feature (437)..(437): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagaggccaggccacggcccccttagttcggtagattataataacggaccagtggagacggccgtcggggactccgngagcgtattctccgtcggctccctcctacgaacgggaccaacgngtctacgttgactcatcgagtggacgtccggagaggagacgagctagacttatacngtacaagtacaacgagactagtagtggtacttagtgtcgtgtacggttcggaacggtaggaccaagcgtgaacccgttcgttacggttcaacggccaacggtcctccgccccgtcgttcctaacccg

SEQ ID NO: 302177 - DNA, 597 bp, Homo sapiens
  misc_feature: GZ8MTXP01EOF8O.52.78.H01.1.454.CMB.2.raw
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccctatggtnatatataaggaccatgagacggaccctgacgggactcccgtgagcgtatctcgtcggctacctcctcgacgggaaccaacngtactacgttgatcatcgagtggagtccgggcaggacggacgagggctaggacttattacgtgtacaatacgaaacgtagaacgtagttaggtgttacgttatgtgtccgtaaggttcggggacggaacgggtaccgaaaggtcttacggacccgttacgttacggttccgacggccccggtaaaggcccgttaccggccccccgttcggtcccgttaaccgtttccccg

SEQ ID NO: 302178 - DNA, 742 bp, Homo sapiens
  misc_feature: GZ8MTXP01A867E.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagctaatatggttattggtaccagcagaggccaggccacggtcccccttagttggtagatatataaaggaccatgagacgccctcgagggactcccgtgacgcgtattcgtcgtccggtcctccgtcccgtacgacgggaaaccaaacgcgtacctacgtttaggactacctaagtcgtaaagggttcgggaacgggttcccggggacgaagggaacgggaacccgggaaggtaccgttaacgggtaaaccgttagtttaacctaggttaacaaaacgttaacccaaagaacggtaaaccgtaagggtttaaaggttccgggttaactttaaggttggtacggtaccggttagggtttaccgggggaccggggtaacggggtaaacccgaaagggtcccgttacggtaaccccggttaccggttacgggttccgaacccggtaaccccgaaacgggtcccgtacccggtaccccccgttccgggttaacccttcccgttttcccccgg

SEQ ID NO: 302179 - DNA, 597 bp, Homo sapiens
  misc_feature: GZ8MTXP01AHB7Z.52.78.H01.1.454.CMB.2.raw
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
  modified_base (541)..(541): a, c, t, g, unknown or other
  misc_feature (541)..(541): n is a, c, g, or t
  modified_base (572)..(572): a, c, t, g, unknown or other
  misc_feature (572)..(572): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtacgcctctggattcacctttaacagttatggatgacttggtccnccaggcctcgagggaagggctggagtgggtgccagcgtgaagcatgatgggaggtgaagganaactagtgacggactcgtggtagaacggggccgtactttaccgaacctacgttcccaagaacgacaaacctataccaaagaaacctacaaattcgttaactcttaaccaaaagtgaacggacaacggtcccaggacacgtcccggaaggacccacggtccgtagttattaccgnggttacgcgttaagttgtttcgttaagggtnttgtttgtcgttcgcaacgtaacgg

SEQ ID NO: 302180 - DNA, 537 bp, Homo sapiens
  misc_feature: GZ8MTXP01C0U5V.52.78.H01.1.454.CMB.2.raw
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatgtaccagcagagcagcagcccctatgtgatatataaggaccatgagaggccctcgaggctccctgagcgattctctcggctcctactcgaggaacaacngtcacgtgactcattcgagtggagtcgggnagaggacggagctgactattacgtgtacaatacgaacagactagtacgtgtacttagtcgtgcgtagttcggngggaaggacgaagcgttacgtaccgtcgttaagggttccacgggccccaaggccgtacgtcccccgttcggtcccaacgtttccccg

SEQ ID NO: 302181 - DNA, 868 bp, Homo sapiens
  misc_feature: GZ8MTXP01BNWN2.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccacgctcggtgtcagtgtcctcaggacagacggccaggatcacctgctctggagatgcactgaccaaagcaaatagtggttattggtaccagcaggaggccgaggccacggtcccccctttagttcggtagtaactataagtaaacgggaccaagttagacggacggtcccctacgaaggggtacttaccccgttagacgtccgtaactttccttcgtggtcccttcccctacccgttaccgaacggggtaaccaaaccgtacggttaccgtaaccggtttacgggaacttacctaacgttcccgtaaagggttcggggaaaccggggttccccgggggaacgtaaacgggggtaaacgggggaaaccgggtaacggggtaccccgttaagggtaaaccgtttaaacgttttaaacccgtttacgggggttaaaccgttaaaactttaaccgaaaaaccgtaaacgggtaaaacccgtaagggtttaacgggttttaacggttaaacgttttaaacggttggttaacggtaccggttaacggggtttacccgggggaccgggggttaaacggggttaaaccgaaaacggggtcccgtttacgggttaaccccgggtttacccgtaacgggttacccgtaaccggtaaccccgggaaacgggttccccggtcccccggttaacccccgtttccccgggg

SEQ ID NO: 302182 - DNA, 626 bp, Homo sapiens
  misc_feature: GZ8MTXP01B2Q6S.52.78.H01.1.454.CMB.2.raw
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
  modified_base (458)..(458): a, c, t, g, unknown or other
  misc_feature (458)..(458): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctgganatgcactgaccaaagcaatagtggttattggtaccagcaggagccaggccacgccccttatggtnatatataaggaccagtgagacggccctacgagggtactcccgtaggacgtacgtacttccgtcgtcggtcccttcccgtccgtacgaacggggaacctaacgacgtaccgtacgttagactacacgttccgaggtcgggacggtcccggganaagggacgggaacgggaggtcgtaggacttacgttacgtcgtaactaaagtccaaagtacgaacgtaggtaagttacggttactttagcggttagcgttaggttccggggacggtaacgggacccgtaaggtcccgtacggttacccgttccggttaacggtaacccg

SEQ ID NO: 302183 - DNA, 714 bp, Homo sapiens
  misc_feature: GZ8MTXP01AZFQA.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctcgtggagatgcactgaccaaagcaattatggttattacggtaccagcgagacggccgacggcccacggtcccccgtttagttcggtagtaacttaataagtaaacggaaccctagtacggaaggaccggaccccgttacggaacggggtaccttcccccgtaggacggaccgttaacgtttccgttccgttccggacccgtttaccgtaacccggtaaacgggaaaccgaaaaccgtaacgttaaccgtacgttagtactacagtacgaggtacgggacggtccgggacgagggaggacggaggtcgtacgtaacgttacgttagttcgtaactaacgtaacaacgtaacgaacgtaaggttagttaacggttattagtgtcgacgttcggttacggacgggaaccggaagaaccgttgtccgacggtaccgtagggttaccgcggttaccgaaccggtaccgtccgccccgtacgttcctaaccgttcccgtttccccg

SEQ ID NO: 302184 - DNA, 558 bp, Homo sapiens
  misc_feature: GZ8MTXP01ESLIQ.52.78.H01.1.454.CMB.2.raw
  modified_base (373)..(373): a, c, t, g, unknown or other
  misc_feature (373)..(373): n is a, c, g, or t
  modified_base (551)..(551): a, c, t, g, unknown or other
  misc_feature (551)..(551): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggcccccttattggtcgatatataaaggaccatgagacggccctacgagggactcccgtgagcgtattctcgtcggcctcctcctcgacgggaaacaacgngtctacgttgatcatcgtaggtggacgtccgggcgaggaggacgaggctagactattactgtacaaatacaacagaacgagtagtgtacttagtgtgtcgtaggttcgggcgggaagggaacaaggcgttacggtaccgtcgttaggttcacgcccagcctccgccccgttcggtccncttcccg

SEQ ID NO: 302185 - DNA, 685 bp, Homo sapiens
  misc_feature: GZ8MTXP01AY8MI.52.78.H01.1.454.CMB.2.raw
  modified_base (652)..(652): a, c, t, g, unknown or other
  misc_feature (652)..(652): n is a, c, g, or t
tcagcgcagtacgacacgaccggtgctcgatttagtgtgagtagtttgggtttgggggctatgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatattggttattggtaccagcagaggccaggccacggtccccttagtcggtagatataagtaacgaccagtggagacggccctacgaggactccgtagacgtcgtacttccctcgtcggtccctcctcccgtaacggaacgggtaaccaaacgtacggtacctacgggttagaactactaacttccgaggttacggggacggtcccggggagaaggggaacggggaacggaggtcccgtaaggtacttaacttacgttacggtactaaacgttaaccgaaacgtaaacgtaccgtaaaggttaacggtttacggttaaactttagttacgggttacgtacggttacgggttaaccgggacggggaaacgggtaccaacgggtactcgggttacccgttcgttacggaacncgaaccgaggtccttccgtcccgttcgtaaccc

SEQ ID NO: 302186 - DNA, 682 bp, Homo sapiens
  misc_feature: GZ8MTXP01C763G.52.78.H01.1.454.CMB.2.raw
  modified_base (269)..(269): a, c, t, g, unknown or other
  misc_feature (269)..(269): n is a, c, g, or t
  modified_base (480)..(480): a, c, t, g, unknown or other
  misc_feature (480)..(480): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggagtcgtgggggagtcttggtccaggccgtggggggtccctgacactctctgtgtacncctctggacttctaactttaacagttattggattgtacgttgggtcccgcgaggcctccggaggggaaggggctgggaggtgggtggcctagcgtagaagcagtgagtagggaaggtaaggaagactaaagtcgcggtactcgtaggtacggaacgggtccgtattaccacctactaccgaagacgaaacaaacataaccaaagaacctanaaatcgtaacttacctaactaaaagtggaacgccgacgtacccgtaggaacctaaacgtcccggaaacggaacccgtaccgggtcccgtttaaggttaaactttccggttagggccgtacgggtaaaggtttcggtttttcggttagggggtaatttttcggggtttgttcggtacggaccctaaccgttaacggttccccg

SEQ ID NO: 302187 - DNA, 599 bp, Homo sapiens
  misc_feature: GZ8MTXP01CJJ3T.52.78.H01.1.454.CMB.2.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttcgtgtaggctatttagaaggtgtcagtgtgaggcgcagctggtggagtcgtgggggagcttggtccagccgtgggggtccctgacnctctctgtgtagcctntggattcacctttaanagttattggatgacttggccncagctcgagggaggcgtggngtggngcgngngagagnagtgagaggaggaggaggaagaacgtagtggcggtacgtcgtggacggacgggacgtactacctacctacctacgaacgaacgaacaacaactaacaaacgaactactaatagtactacgtaactaaagtacgacgacgacgaccgacgacacgtaccgaacggaaccggacggtaacggtacgttagttacgttacggtaggtcggttaggttcggtttcggtttgggttgttggttcggttcggttcgtccgttccgtcg

SEQ ID NO: 302188 - DNA, 614 bp, Homo sapiens
  misc_feature: GZ8MTXP01DFVPO.52.78.H01.1.454.CMB.2.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatgggttattggtacagcagaggccagcacggcccctatggngatatataaggacatgagaggcccctgagggactcccgtgacgcgtacttctcgtcggccttccgtccgttcgacggggaaaccaaacgtcgtacaaccgggtttanactctacgtcgtaggtacgggacgtccgggagaaggaggacgtacggctagtaacttagttacgtacgtactaactacgaaacgagtaacgtaagttaaggtagttaactttagtcggtgtacgtaggtaccgggagggaacggtaacgaacgtcgttacggtaccgtcgttacgcgaccgtaacccgaggtccgtcccgtacccgttcgtaaccttccgttccg

SEQ ID NO: 302189 - DNA, 701 bp, Homo sapiens
  misc_feature: GZ8MTXP01BPOTV.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctgganatgcactgaccaaagcaatagtggttattggtaccagcagaggccaggccgacggtcccccttagttcggtagtataataagtaaaggacctagtggaagacggccctacgacgggtactcccgtagacgcggtatttcccgtctcggccttccctcccgtaccgaacgggaaccaaacgtacgtacgtacggtttacgactacgtataccgtagggtaggggtaacgggtacccgggggacgaacggggaaacgggaccgggaaacgggtccgttaggaaacttaacgtttaacgtacggttaacaaacgttaccgaaaacgaacgaacgtaaggttaagttaggttaactttagtcggtgacgtacgggttcgggacgggacggggaaccaggccgttacgaaccccggttcgttaaccgggtccgacgtaacccggaacgggtccgttcccggtcccccgttcggttaaccccg

SEQ ID NO: 302190 - DNA, 559 bp, Homo sapiens
  misc_feature: GZ8MTXP01BWKPH.52.78.H01.1.454.CMB.2.raw
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgggttattggtaccagcagaggccaggccacggccccttatggtnatatataaggaccagtgagacggccctcgagggactcccgtggacgcgtattctcgtcggcctcctcctcgagggaaacaacgngtcacgttgactcatcaggtgagtccgggnaggaggcggaggctgactattactgtacaatcgaacaggacagtagtggtacttagtgtgctaggtcgggcggtaacgggacaaggtcgttcgacccgtcgacggttcacggtaacccgaaggtccgtacccgccccgttcggtcccttcgttcccg

SEQ ID NO: 302191 - DNA, 685 bp, Homo sapiens
  misc_feature: GZ8MTXP01B52P9.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctgggcctcctatgaactgacacacgccaccctcggtgtcagtgtcctcaggacagacggccaggatcacctgctcgtggagatgcacgtgaccaaagactaatagttaggttattacggaccagcaaggacggcccgaacggccgacggcccttgtggttggtagatagtaaataaacgacacgtagagacggaccctagacgggtactccgtagacgtcgtacttccgtccgtcggtctaccgaggtccgaaacgggaccgaacgtcgaactacgttcgacctacgtcgtaggtacggacgtacccgaagggcgaacggagggtaaccgaggtaccttagaacgtttagttaagttcgaaacccgttaaacgtacaaacgtaaccgtaaccgttaacgttacgtttacgttacgtttacgttcgttaccgtaacggtacgtcgaaccgtaaccgttacggtaccaccggtacggtcggaccgaccgaacccgtaacccaccccgtaacccgtcgtaccgttacctccgttcccgtaacccg

SEQ ID NO: 302192 - DNA, 591 bp, Homo sapiens
  misc_feature: GZ8MTXP01EDU94.52.78.H01.1.454.CMB.2.raw
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcaggagcgaggccacggtccccttagttggagtatatagaaagccaatgagacgccctacgaggactcccgtgacgcgtacttctcgtcggccttcctcctacgacgggaaaccaacgngtctacgttagactcagtcgaaggttcggacgtccgggagaggaggacggaggctaggaaccttatacgtgtaactaanacaaagagacgtagtagtagtacttagtgtgcgtagtcggacgggaacggaacgaacgcgttacggtacccgtacgttaacggttcaacgccggaaacgtcccgttccgccccgttacggtccttaaccgttcccg

SEQ ID NO: 302193 - DNA, 546 bp, Homo sapiens
  misc_feature: GZ8MTXP01C8SNU.52.78.H01.1.454.CMB.2.raw
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
  modified_base (449)..(449): a, c, t, g, unknown or other
  misc_feature (449)..(449): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtaccagcagagcaggcagcccctatggtnatatataaggacatgagacgcctcgaggatccctgagcgattctctcggctctctcgaggaacaacngtcacgttgatcatcagtgagtcggcaggaggagaggctgacttatactgtacaaatacggaactagactaaggtagtgtacttagtgtacgtcaggttcggngggaacgggtaacgaaggtcgttacggtacccgtacgttacggttcgacgaacccgaaacggtccgtaccgccccgttcggtccaacccgtttcccg

SEQ ID NO: 302194 - DNA, 614 bp, Homo sapiens
  misc_feature: GZ8MTXP01EN6FE.52.78.H01.1.454.CMB.2.raw
  modified_base (272)..(272): a, c, t, g, unknown or other
  misc_feature (272)..(272): n is a, c, g, or t
  modified_base (546)..(546): a, c, t, g, unknown or other
  misc_feature (546)..(546): n is a, c, g, or t
  modified_base (578)..(578): a, c, t, g, unknown or other
  misc_feature (578)..(578): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggcttggtccaggccgtgggggtccctgacactctcctgtgtacgcctntggattctaacctttaacagttatggatgtacgttcgggccgcgaggctccggaggggagggctggagtgggtgccagcgtgagcagtgagtgggaggtgaaggaagaactagcggcgtactcgtggtaggaacgggctattccgacctacttaccgaagacgaacaaacgactacaaacgaactacaattacgtacttaccggtaactaaaagtcgaacgacacgcccgtaggaacctacgtaccggacgaccgaccggtcgtattagttcgngtcggacgttaggttcgtttgggttaagggtntttgggttcgttcggttcgaaccgaaccgtaaccgg

SEQ ID NO: 302195 - DNA, 671 bp, Homo sapiens
  misc_feature: GZ8MTXP01BS7WJ.52.78.H01.1.454.CMB.2.raw
  modified_base (457)..(457): a, c, t, g, unknown or other
  misc_feature (457)..(457): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcgttggtccagccgtggggggtccctgacactctcctgtgtacgcctctggtacttctaacctttaacagttatggatgtacgttgggcccgccaggcctccgaggggaagggggctgggaggtggggtcggcccgaggcgtgaagcagtggagtggggaggtggaaggaagaactatggcggtactcgtggtaggaacggggcctattccacctacttccagacgaaccaaanactacaaagtaactacgaaatgtaataccgtaaccaaagtcgaagccacgacccgtagaacctacgtcccgggaaacggacccgaccggggaacccgttgttaaacgtttaccggttgggtaccggacggttaagggtttacgttttaccggtttgggggttaacttttgggtttcgggttccggtttcgaaccccggttaaccgttaaccggg

SEQ ID NO: 302196 - DNA, 646 bp, Homo sapiens
  misc_feature: GZ8MTXP01ATA68.52.78.H01.1.454.CMB.2.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagtcttggccagccgtgggggtccctgacnctctcctgtgtagcctntggattcacctttaanagttatggatgacttgggccncaggctcgagggagggctggagtgggtcgccaggcgtgaagcagngagtggaggtgaggaanaacttagtggtggacttgtaggtaggaacgggtccgtattccaaccctccttaccgaggaacaaccaaacgtatacgaaaacgaactactaaattcgttaactaccgttaaccaaaagtgggaaacgccgaacgccgtagaacctaccggtaccgggaacggaccggacgggtccgttagttaaacgttacgttggtacggtacggttaaggtttcgggttttacggttaaggggtagtttcgggttacggttccggttacgtaacccgttaaccggtaag

SEQ ID NO: 302197 - DNA, 683 bp, Homo sapiens
  misc_feature: GZ8MTXP01ELZ74.52.78.H01.1.454.CMB.2.raw
  modified_base (291)..(291): a, c, t, g, unknown or other
  misc_feature (291)..(291): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatattggttattggtaccagcagaggccaggccacggccccttagtggngatatataacggaccatggagacggccctacgagggtactccgtacgagtcgtatttccctcgtcggtcccttcccgtccctaacggaacgggaaccaaacgtacgtactaccgggtttagactactacgtcgtaggtacgggacgggtaccgggacgaagggaacgggacggtaggtacgtacgtaacgttaagttacgtagtaactaacgtaaccaacgtaacgtacgtaaggttacgtttacggttaacttagtcgtacgtaccggtagggtccggggaacgggttacgggaaaccgttacggtaccgtaaccggttacccggttcggttacggtaaccgaccggtaacccggaaccgtcccgttaccccgtccccggttcgtaacccg

SEQ ID NO: 302198 - DNA, 550 bp, Homo sapiens
  misc_feature: GZ8MTXP01DIC8Q.52.78.H01.1.454.CMB.2.raw
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattgtaccagcagaggcaggcagccccttatgtgatatataagacatgagagcctcagggactccctgagcgtattctctcggctctctcaggaacaacngtcacgttanatcatcgagtggacgtcggagaggaggacggagtcgtagtactattacgtagtactaaataacgaacgtaacgtagtaagtagtagttatagtgtgtacgtacggtcgggacggaacggaacgagtcgttacgtaccgtacgttacggcaccggtaaccgacgtccgtcccgcccgttcgtccgttccgtccg

SEQ ID NO: 302199 - DNA, 577 bp, Homo sapiens
  misc_feature: GZ8MTXP01CK8LQ.52.78.H01.1.454.CMB.2.raw
  modified_base (463)..(463): a, c, t, g, unknown or other
  misc_feature (463)..(463): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagttcggtagatatataaggaccagtgaggacggccctcgagggactcccgtagacgcgtattccctcgtcggtcctccctcctacgacgggaacaacgtacgtcgtacgttgactcatcaggtggacgtccgggacaggacggacggaggcctagacttattactgtacaatacaanagactagtagtaggttactagtgtagcgtaggtcggacgggagggacgagtccgtggacccgttcgttacggtcgacgtaacccgagtccgttaccgtccccgttcggtaaccc

SEQ ID NO: 302200 - DNA, 665 bp, Homo sapiens
  misc_feature: GZ8MTXP01BSKNO.52.78.H01.1.454.CMB.2.raw
  modified_base (636)..(636): a, c, t, g, unknown or other
  misc_feature (636)..(636): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtcccctgacactctcctgtgtagcctctggattcacctttaacagttatggatgacgttgggtccgcaggctccgagggagggctgggagtgggtggccagcgtgaagcagtggagtggggaggtaggaaacgggaaagaaaccgttagtcgggacggtaaccgttccgtgggtacgggaaacggggtcccgtaatttcccaaccctaccgttacccgaagaaacgaacaaaacactacaaaacgtaacctacaaagttagtaactacctaaccgtaaaagtcggaacgaccaacgtcccgtaggaaacctacgtacccggaacggaccgtaccgggtccggttaagttacgttaccgttgtcgcggttagttacgtttgggtttaagggtnttggtttcggcgtttcgcccgaacgtccg

SEQ ID NO: 302201 - DNA, 501 bp, Homo sapiens
  misc_feature: GZ8MTXP01A6K1U.52.78.H01.1.454.CMB.2.raw
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggcccctnagggatcccgtgagcgattcctctggctcctcctcacgggcaacagtcacgtgatcatcagtggagtcgggcaggaggacgaggcngactatactgtcgaatcaacagacagtagnggtactatgtagcgagtcggnggaggacagctgaccgttcacggtcagccaggcttcgccccgttgtcc

SEQ ID NO: 302202 - DNA, 737 bp, Homo sapiens
  misc_feature: GZ8MTXP01BUFTR.52.78.H01.1.454.CMB.2.raw
  modified_base (221)..(221): a, c, t, g, unknown or other
  misc_feature (221)..(221): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatggttatgtaccagcagagcaggccacggtcccctagtgtgatatataaggaccatgagacggccctcgacgggtactcccgtagacgcgtacttcgtcgtcggtccttcctccgttacgaacggggaaacccaaacgtaaggttacctaaacggtttagaacttaccgtaacttcgaacgggtcggggtaacgggtcccggggaacgaacgggaacggggaacggtaacgggtacgttaggtaaccgtttaacttaacgtacggttaactaaacgttaacaaaccgtaagtaaaccgtaacggttaaggttaacgggttaactttaggtaggttacgtacggtagggttaccggggcggggtaaacgggaaccgttaaacgggtccgttaccgggtaacccgttaccggttacgggttccgaaccgggaaccccgtaaacggggtcccgtttaacccgggcccccggttcgggtaacccttaacccgtttccccg

SEQ ID NO: 302203 - DNA, 756 bp, Homo sapiens
  misc_feature: GZ8MTXP01AGAY6.52.78.H01.1.454.CMB.2.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (506)..(506): a, c, t, g, unknown or other
  misc_feature (506)..(506): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagctgggttttccttgttgcttattttagaaggtgtccagtgtgaggcgcagcgtggtggagtcgtgggggagtcgttggtccagccgtgggggtccctgacactctcctgtgtacgcctctggtattcaaccctttaaangtttatggatgacgttggccnccgtaggctaccgaggggaaggggcgtaggaggtgggggtcggacccagggtcgtaggaaacgctagtggtaacgtggggaggtggaaagaaggtaacttagtcggtaccgggaactcgttagggtacggaacggggtaccgttaacttacccggaacctaccttaccgaaagggacgttaaaaccaaaccgtnttaaaaccggaaaacgtaaacccttattaaaacggtttacgttaaacctaaccggtaaacgtaaacggtcgaaaccgtaccgaccggtttacccaggaaaccctaccggggtaaccggaacccgggtaaccggtccggttcctttaaaggtttaacgttacggttgggtaccggtaacgggttacggtttggttttacgggttggtacgttttcggttacggttcgttaccgaacccgttaacgtcccgg

SEQ ID NO: 302204 - DNA, 675 bp, Homo sapiens
  misc_feature: GZ8MTXP01B3P0Z.52.78.H01.1.454.CMB.2.raw
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcacctgctctggagatgcactgaccaaagctaatatggttatgtacagcagcgcaggccacgtccctatggtgatatanaaggacatgagacgcctcgaggactccgtgagcgattctcgtcggcctcctctacgaggaaacaacngtcagttnactcatcgagtcggacggtccgggacgagggaaggtacgggagggtcctagtaaacgttacttaacgtacgtactaaacttacgaaactaacgtaaccgtaagggttaaggtacggtttaaaccttagttaggtacggttacggttacgggttcgggggaacggggtaaacggggaacccgttaaacgggtccgttaacgggtaaccccggttcccgtttaaacggggttcccgaaccgggaaccccggtaaaccgggtcccgttccccgggtacccccggttccgggttaacccttcccgttttccccggg

SEQ ID NO: 302205 - DNA, 748 bp, Homo sapiens
  misc_feature: GZ8MTXP01AB583.52.78.H01.1.454.CMB.2.raw
  modified_base (222)..(222): a, c, t, g, unknown or other
  misc_feature (222)..(222): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctcgtgganatcgcactgaccaaagcaatatggttattggtaccagcagaggccaggccacggcccccttagtcggtgatatataaacggaccatcggagacggccccttacgagggtactcccgtggacgccgtaattcgtcgtccggccttccgtccgtaccgaggggtaaaaccaacgtaagtcccgtaacggttaggactacctaagttaccgaagggtttacgggacgggttacccggggaacgtaaggggaacgggtaacggaacggggtacttacggtaaacgtttaacgtttaaccgtacggttaaacgaaacgttaaaccccgaaagaaacgggttaacccgaaagggtttaaccggtaacggggtttaacttaaaggttgggtacgtcgttaaacggggtttccgggacggggaacgggtacccggttaaagggtcccgtttaaacccggtcggtttaaacgggcttaaccgggcccgaagggtcctccgtaccccggtcggttactaaccgttccgttccccgg

SEQ ID NO: 302206 - DNA, 551 bp, Homo sapiens
  misc_feature: GZ8MTXP01EUIFQ.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacgacggccaggatcacctgctctggagatgcactgccaaagcaatatggttattggtacagcagaggcaggccagccccttatggtgatatataaggaccatgagaggccctcgagggatccctgagcgattctctggccctcctctcgagggaccaaacagtcacgtgatcatcagtggacgtccgggcagaggacgaggctgactatactgtcaatcaacagacagtagtaggtactagtgtagcgtaggttcggcgggaaggggaacccaaggttcgtacggaccggtccgtaaggttccgcggacccgaaggggctccggccccccgtgggttcctaaccgttccgttccccg

SEQ ID NO: 302207 - DNA, 602 bp, Homo sapiens
  misc_feature: GZ8MTXP01A3AYS.52.78.H01.1.454.CMB.2.raw
  modified_base (327)..(327): a, c, t, g, unknown or other
  misc_feature (327)..(327): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctctcactctctgcacaggctctgggcctcctatgaactgacacagccaccctcggtgtcagtgtcctcaggacagacgccaggactcacctgctcgtggagatgcactgccaaagcaatatggttatggtaccagcagacgcaggccacgccccttatgtgatanataacgcatcgagagcctgaggaactcccgtgagcgtattctcgtcggctcctcctcgagggaacaacgagtcgacgttgactcattcgaagtggaacgtcgggggacgaggaacgggacgacggtcgtacgaacgtttacgttacctcggttacaaacgttacaaaacccgaagttaaccgtaaaggttccgtaagggttaacttaacggttggttacgtaacggtaacggtttcggggacgggtacgggaacccgtaaggccgttaacccggg

SEQ ID NO: 302208 - DNA, 531 bp, Homo sapiens
  misc_feature: GZ8MTXP01D56LQ.52.78.H01.1.454.CMB.2.raw
  modified_base (360)..(360): a, c, t, g, unknown or other
  misc_feature (360)..(360): n is a, c, g, or t
  modified_base (450)..(450): a, c, t, g, unknown or other
  misc_feature (450)..(450): n is a, c, g, or t
  modified_base (523)..(523): a, c, t, g, unknown or other
  misc_feature (523)..(523): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattgtacagcagaggcaggccaggccccttatggtgatatataaggaccatgagaggcctcgagggactccctgagcgattctctcggcctcctcctcgacgggaaacaacgngtctacgttgactcatcagtggacgtcgggcagaggacgaggctagactattactgtacaatcaacagactagtagtcgtattagtgtgntaggttcggcggaagggacaaggcttgaacccgtcgttacggttcacgccgaaggcctcgccccttcggtccncgttcccg

SEQ ID NO: 302209 - DNA, 623 bp, Homo sapiens
  misc_feature: GZ8MTXP01CL87Q.52.78.H01.1.454.CMB.2.raw
  modified_base (426)..(426): a, c, t, g, unknown or other
  misc_feature (426)..(426): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaaccagcaggacggccgaggccacggtcccccttagttggtagatataagtaaaggaccatagagacggccctcgagggactcccgtgagtcgtattctcgtccggccttccgtcctacgaacgggaaacaacgtgtacgtacgttgactcatcgaggtcggacgtccggganacgggaggacggaggtccgtagacgttagttacgttcgactaactacgaaacgaaggtacaaggttagtagtacgttagtgtgtcgtaggttcggacgggaacgggaacaggtccgttacggtaacccgtccgttaggttccacggaacccgtaaggtcccgtaccggccccgttacggtcccttaacgtttccccg

SEQ ID NO: 302210 - DNA, 548 bp, Homo sapiens
  misc_feature: GZ8MTXP01AIYG4.52.78.H01.1.454.CMB.2.raw
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggtatgtacngcagagcagcagccctatcggngatatataaggaccatgagaggccctgagggatccctgagcgattctctcggctctctcgaggaacaacngtcacgttgatcatcagtggagtccggnagaggacaggctagtactattacgtgtacaatcgaanagacagttagtggtacttagtagtcgcgtagttcgggcgggaacgggaacaaggtcgttcggacccggttacacggggttccaacgggccccgaagggtccgtaccggtccccccgttagggttcccaacgtttccccgg

SEQ ID NO: 302211 - DNA, 578 bp, Homo sapiens
  misc_feature: GZ8MTXP01C6WE7.52.78.H01.1.454.CMB.2.raw
  modified_base (380)..(380): a, c, t, g, unknown or other
  misc_feature (380)..(380): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatataggttattgtaccagcgagacggccaggccacggtcccccttagttcggtgatataagtaaaggacctagtagagacggccctcgagggactcccgtagacgcgtattctctcggcctcctcctcgacggaacaacncgtctacgttgatcatcagtggtacgtcggacgaggaggacgaggctagtactattatgtaacatacgaaacagaactagtagtcgtattatgtgtgtaggttcggcgggaacggtcgaagtcgttacggtaccgtcgttacggttcaccggtccgaacggtccgtacccgccccgttcggtccttaaccgttccccg

SEQ ID NO: 302212 - DNA, 585 bp, Homo sapiens
  misc_feature: GZ8MTXP01B2R1W.52.78.H01.1.454.CMB.2.raw
  modified_base (269)..(269): a, c, t, g, unknown or other
  misc_feature (269)..(269): n is a, c, g, or t
  modified_base (336)..(336): a, c, t, g, unknown or other
  misc_feature (336)..(336): n is a, c, g, or t
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgacccaaaagcaaatattggttattggtaccagcagnggccaggccaggcccccttattggtgatatataaggacatgagaggccctgagggactccctgacgngactttcctctggctccctcctacaagggaaccaacgtacgtcaacgttgattcatcgagtggacgtcggcgaggaggacgagcngactatactgtacaatcgaaanagaactagtagtacggtattaagtcgtgcgtaggttcgggacgggaacgggaccaacgggtacgtcggttacccgttcggttaacggttaaccgacgtaaccccgaaggggtcccttaccgtccccccgttaacgggttccc

SEQ ID NO: 302213 - DNA, 641 bp, Homo sapiens
  misc_feature: GZ8MTXP01EZPCT.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctcgtggagatgcactgaccaaagcaatatggttattggtaccagcagaggccaggccacggcccccttagttcggtagatataagtaagaccatgagacggccctcgagggactcccgtgacgcgtattctcgtcggccttccctccgtcgacgggtacaacgtagtcgtacgttgactctatcgtaggtcggacggtccgggacgaagggacgggacggggacggtacgtacgtaaccgttaagttaccgtgttaacgtaaactactaaaaccgagtaaaccgtaaggttaacggttaggtttaaactttaggttggtacggtacgttacgggtttcggggacggggtaacggggtaccaaagggtccgttacgggaccccgttccggttaacgggtaacccgg

SEQ ID NO: 302214 - DNA, 711 bp, Homo sapiens
  misc_feature: GZ8MTXP01AV33C.52.78.H01.1.454.CMB.2.raw
  modified_base (470)..(470): a, c, t, g, unknown or other
  misc_feature (470)..(470): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggagcttggtccagccgtgggggtccctgacactctcctgtgtagcctctggtattcaacctttaacagttatggatgtacgttcgggtcccgccgaggcctccggaagggggtaaggggcgtagggaggtgggggtcggcccgaggcgtagaagcagtgagtggggaggtagaacggaagtaactagtcggacgtactcgtgggtaggaacgggccgtattacccacctaacctcgaagaacacaaacgntaaccaaagtaactcaaagttctaactacctaaccaaaagtcgaaacgcgaacgcccgttaggaacctacgtaccccgggaagggaccccgtacgggtcccgtttagggtttaactttaaccggttgggtaaacggtcccggttaaaggggtttttcggtttttccggggtttttaagggggttactttttcgggggtttttccgggttaccggttaccgaaccccgttaacccgggtcgg

SEQ ID NO: 302215 - DNA, 577 bp, Homo sapiens
  misc_feature: GZ8MTXP01APC61.52.78.H01.1.454.CMB.2.raw
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
  modified_base (511)..(511): a, c, t, g, unknown or other
  misc_feature (511)..(511): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtcccctgaccactctcctgtgtagcctntggattcactttaacagttatggatgacttgggtccncaggctccgagggaggggctggagtgggtggcaggcgtgaagcatgatggagtggagagaactangcggatcgtgtagacgggctagttcacctactccgagacgaacaacatacaaagaactacaaatgtactcgtacaaagtcgagcaagcctggaacagtcccggaaggaccgacgggtccgttagttaacgtttaccgnggtacgtcggttagttagtttccggtttggggatttgggttgtccgtttgcccgttaacgtaaccg

SEQ ID NO: 302216 - DNA, 681 bp, Homo sapiens
  misc_feature: GZ8MTXP01DKDIG.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctgganatgcactgaccaaagcaatatggttatcggtacagcagagccaggccacggtcccctagttcggtagataataagtaaacggaccagtagaacgacggcccctagaacggtactcccgtagacgtcgtactttccctcgtcggtccctccctcccgtaacgaagggaaccaaacgacgtaccgtacgtttagacttactacgtacgtaacgggttcgggaacgggttccggggacgaagggaacgggaacgaggtaccgtacggtaaccttaagttacgtagtaacgaaacttacaaacgacgtaacgtaaggttagttaggttaacttagtggtacgtcgtacgggttaacggacgggaacggaaccgttaaaggtcgttaacgacccgttcggttaccggtcgaaccgtaacccgaacggcccttcccgggtcccccgttaacgggttaaccccg

SEQ ID NO: 302217 - DNA, 646 bp, Homo sapiens
  misc_feature: GZ8MTXP01EJ48I.52.78.H01.1.454.CMB.2.raw
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatgttatgacagcagagcagccacgccctatgnatatanagacatgagacggccgtcgggatcccgtgagcgtacttctcgtcgtccctcctacgtcgaagggaccaaaacgtacgtcgacgttagactcactcgaggtggacggtcggacaggaggacgagcgtagtaacttatacgtagtacaaataccaaacggaacgtaagtaaggttagttacggttaagttaaagttggtaacgtccggtaaagggtttccggggaacggggtaaggggaaaccccgaaaggttccggttacggttaaccccgttaaccccggtaagggttacccgaaccggaccccggaaacggtcccgtccccggtcccccgttcgggttccctaacccggttttcctttcccccggg

SEQ ID NO: 302218 - DNA, 576 bp, Homo sapiens
  misc_feature: GZ8MTXP01EE75J.52.78.H01.1.454.CMB.2.raw
  modified_base (281)..(281): a, c, t, g, unknown or other
  misc_feature (281)..(281): n is a, c, g, or t
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagcccaccctcggtgtcagtgtcctcaggacaggacggccaggatcacctgctctggagatgcactgaccaaagcaatatggttattggtacagcagagcagccacgccctatggtnatatataagacatgagaggcctgaggactccgtgagcgtatctctcggcctcctccgtacgacggaaaccaacngtcctaagttgactactatcgaggtaggacgtccggganaggaggacgaggtctagactattactagtacaatacaaacgngtaacgtagtagtaggtattagttagtgtacgtagggttcggacgggtaaggaccgttaaaggccgttaggacccgtttacgaacggttcgaccgcccgaagtccgttccgcccccgttacggtccttaacgtttccccg

SEQ ID NO: 302219 - DNA, 552 bp, Homo sapiens
  misc_feature: GZ8MTXP01AZ0ZR.52.78.H01.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (458)..(458): a, c, t, g, unknown or other
  misc_feature (458)..(458): n is a, c, g, or t
tcagcgcagtacgacacgaccggtgctcgatttagtgtgagtagtttgggtttgggggctgtgggtccaggaggaagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagaggccaggccaggccccctagttcgngatatataaggaccatgagacggccctcgagggactcccgtgacgcgtattctcctcggctccctcctcgaacgggacaacagtcacgttgatcatcagtggagtcggcagaggacgaggctagactagtatgtacaagtcaaacgtagactagtacgtaggtacttangtgcgtagttcgggaacggagggaccaaggcgtacgaccgttccgttagggttccaacgcccgaaggtccgtccgccccgtcggttctaacccg

SEQ ID NO: 302220 - DNA, 657 bp, Homo sapiens
  misc_feature: GZ8MTXP01AL1A1.52.78.H01.1.454.CMB.2.raw
  modified_base (182)..(182): a, c, t, g, unknown or other
  misc_feature (182)..(182): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtntcagtgtcctcaggacagacggccaggatcacctgctctggagatgcactgaccaaagcaatatgttattggtaccagcagaggcaggccaggccccttatcggtgatatataagaccatgagacggccctgacgggactcccgtgacgcgtacttcccgtctggtcctccctccttacgacgggaacctaacgaggtctaacgttgactcagttaccaggttacggacgggttcccgggaccgaaggaacgggacgaacggtcgtacggtacttaaactttcccgtaggtaacgtaacgttaaccaaacgtaaacggaacgtaaggttaaccggtaggggtttaaaccttaggtaacgtggtacgtaaagggttccgggacgggaacgggggacccttaaaggtccgtaacggttacccgttcgttacggtcgacgcccgaacggtccttcccgtccccgttcggttaaccccg

SEQ ID NO: 302221 - DNA, 531 bp, Homo sapiens
  misc_feature: GZ8MTXP01BNHQB.52.78.H01.1.454.CMB.2.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagngcaggccagcccctatgngatanataaggccaaaatgagagcctgaggactccctgagcgattctctcggctcctcctgacgggaaacaacngtcacgttgactacatcgaagtggagtccgggacaggaggacgaaggctggactattactgtacaatacgaaatagaactagtagtcggtattagtgtgtgtagttcggngggaaggacgaagcttcgacgtcgttagcncgaacccgaggcctcggccccttacggtcaacttcccg

SEQ ID NO: 302222 - DNA, 718 bp, Homo sapiens
  misc_feature: GZ8MTXP01AG717.52.78.H01.1.454.CMB.2.raw
  modified_base (283)..(283): a, c, t, g, unknown or other
  misc_feature (283)..(283): n is a, c, g, or t
  modified_base (430)..(430): a, c, t, g, unknown or other
  misc_feature (430)..(430): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctcgtggagatgcactgaccaaagcaatatggttatcgtacagcagagcaggccacgtcccttagtgnatatataaggaccatgagacggccctgaggactcccgtgacgacgtacttctcgtcggtcctcctccgtacgacggaaaccaaacgcgtaccgtaacgtttcgaacttacgataccgaaggtacggggtaccggtaccccggggganaacgggaaacgggaaccgggtaacggtaccgttaaggtaaccctttaaggttaccttaggaacctaaacgtaaccgaaaaccgaaggtaaaccgtaaaggttagggttaaccgtaagtttaagttgggtacgttaccgggtaacgggtttccgggaaccgggggtaacggaaaccggttacgtacgttaccgggtaaacccgtacccggtttacggaccggttaacgaaccccggtaacggtccgttaccccggcccccgttccgggtaacccaaccgtttcccccgg

SEQ ID NO: 302223 - DNA, 628 bp, Homo sapiens
  misc_feature: GZ8MTXP01CRJ34.52.78.H01.1.454.CMB.2.raw
  modified_base (330)..(330): a, c, t, g, unknown or other
  misc_feature (330)..(330): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagttcggtgatatataaggaccatgagacggccctcgagggactcccngacgcgtattctctcggcctcctccgtacgacgggaaaccaacgtgtactaacgttgactcattcgagggtcggacggtccggggacgagggacggaccggagggtcctaggtacttattacgagtacaaagtacaaacgagactaaggttacgtaggttaactttaagtggtgtaccgtaggttccggggaacggaacggggaaccaaacgggtcttcggtaaccgttccgttaacggttccgaccggtaacccgaacggcctaccggcccccgttcgggtcccttaacgttccccg

SEQ ID NO: 302224 - DNA, 656 bp, Homo sapiens
  misc_feature: GZ8MTXP01AQRIO.52.78.H01.1.454.CMB.2.raw
  modified_base (269)..(269): a, c, t, g, unknown or other
  misc_feature (269)..(269): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (495)..(495): a, c, t, g, unknown or other
  misc_feature (495)..(495): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtggggggagcttggtccagccgtggggggtccctgacactctcctgtgtagcctntggattcaacctttaacagttatggatgtacgttcgggccgcgaggctccgaggggaggggctgggagtgggngccaggcgtgaagcagtgagtgggaggtagagganaactatggcggtactcgtggtacggaacggggtcctaacttccaaccctaacttcccgaaggaacaactaaaccatacccaaaagtaacctacaattgtaactccgtaactaaaaggngaaccgcacggtacctagaacctcgtacccggaacggaacccggtccgggtcgttaagttacttacgggttaggtacgggtacggttaaggtttcgggtttttacgggtaagggttagtttcgggtttcggttaccggttcgtaaccccgttaacgtccgg

SEQ ID NO: 302225 - DNA, 780 bp, Homo sapiens
  misc_feature: GZ8MTXP01D4TTO.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaattagttaggttattcggtaccagacgagaggaccacggccacggtaccccttagttcggtagtataataagtaacggaaccagtagaacgacgccctacgaggactccgtagagtcgtacttcctctcggtcctccgtcctaacgacgggtaacaaacgtacgtacgtacggttagactctaacgtcgtaaaggttcgggaccggtccgggacgaagggaacgggaacggtacggacgttacggtaaacttaacgtttaacgtcggttaaacgtaaaaccttaaacgtaaaacgaaccgtaaacgtaaagggtttaacggtttaggttttaaaccgttaaaggtttgggttacgtacggttaacccgggggtttaacggggtaacccgggggttaaacggggaaacccttaaacggggtacccgtaacccggggttaacccggttccgggttaaaccgggttaacgaaccccgggaacccggtaaacccgggtccgttacccccgttcccccccgggttaacgggtttaacccccg

SEQ ID NO: 302226 - DNA, 656 bp, Homo sapiens
  misc_feature: GZ8MTXP01CBMFR.52.78.H01.1.454.CMB.2.raw
  modified_base (222)..(222): a, c, t, g, unknown or other
  misc_feature (222)..(222): n is a, c, g, or t
  modified_base (413)..(413): a, c, t, g, unknown or other
  misc_feature (413)..(413): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagactaatagttaggttattacggtaccagcgaaggacggccgaggccacggtccccctttaagttcgggtagataataagtaaacggaccagtagaggacggcccctacggaagggtactacccgtggacgtcgtattcctcgtccggtcctcctccgtacgacggaaacctaacgngtcgtacgttagactacagtcgtaggtaggacggtccgggacgagggacggacggacggtcgtagtacgttagttaccgtagtactaatacgaaactagtaactagttagtacgttattagtggtcgtacgtacgggttcgggcgggtaacgggacaacggcgttcggtaaaccgtccgttacgggttcgaccgaacccgacggcccgtcccggccccgttcggtaaccgttccgtttccccg

SEQ ID NO: 302227 - DNA, 523 bp, Homo sapiens
  misc_feature: GZ8MTXP01AZGK4.52.78.H01.1.454.CMB.2.raw
  modified_base (267)..(267): a, c, t, g, unknown or other
  misc_feature (267)..(267): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtagcctntggattcacctttaacagttattggatgacttgggtccgcaggctccgagggagggctggagtgggtgccagcgtgaagcagtgatgggaggtgaggaagaactagtgcgactgtgtggaacgggcgtattccaccacttacagagacaaacatacaagaactcaatgtatcactaaatgaacgcagctagacacgtccgagaccncggctgttatacngtgcgngttgttcgttggatgtgtcgttagcncgtcg

SEQ ID NO: 302228 - DNA, 656 bp, Homo sapiens
  misc_feature: GZ8MTXP01CTA8U.52.78.H01.1.454.CMB.2.raw
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (583)..(583): a, c, t, g, unknown or other
  misc_feature (583)..(583): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtggggggagtcgttggtccgagtccggtggggggtcccctggacactctcctgtgtagcctctggtacttcaccctttaanagtttatggatgacgttggtcccgcaggcctcggaggggaagggctgggagtgggtgccaggcgtagaagnagtgngtagggaggtagaaggagtaacgtagtcggcgtacgtgtaggtacggaacggtctacttaccactacgtacgaagaacaacaaacgtactaacgaaacgtaactactaagttacgtaacttaccgtaaacgtaaagtcgaacgcgaacgtcgtaagaccgtacggtacccggaacgggtaccgtaacgggtcgtttaagttacgttacgnggtaacggtcggttaagtttcggtttcggttaaggtgtttcggttcgttcgttccgtaaccgttaacgtccgg

SEQ ID NO: 302229 - DNA, 565 bp, Homo sapiens
  misc_feature: GZ8MTXP01CYZJW.52.78.H01.1.454.CMB.2.raw
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (429)..(429): a, c, t, g, unknown or other
  misc_feature (429)..(429): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggcagcccctatggtnatatanaagacatgagacgcctcgaggactcccgngagcgattcnctcggctcctctacgaggaacaacngtacacgttagactacatacgaagtggtacgtacccgggagaggaacgggacggaaggtctaggaaccttatactgtanaactacgaaactacgataagtacgttagtacttagagtgtcgtaggttcggacggaaggtaaccaggtcgttcgtaaccggtcagggttcacgtaacccgaacggctacggccccgttcgtccttaaccgttcccg

SEQ ID NO: 302230 - DNA, 598 bp, Homo sapiens
  misc_feature: GZ8MTXP01DU17Z.52.78.H01.1.454.CMB.2.raw
  modified_base (373)..(373): a, c, t, g, unknown or other
  misc_feature (373)..(373): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacaggacggccaggatcacctgctctggagatgtactgaccaaagcaaatatggttattggtaccagcagaggcaggccacggccccttagtgtgatataataaggaccatgagacggcctcgagggactcccgtgagcgtacttctcgtcggccctccctcgtcgacggacaaaacgngtctacgtgaactctatacggtagtcgggacggtccgggacgaagggacgggacggagacgtaggtactagttaccagttaacaagtacaaagtagacgtaagtagttagtactttgtgtgacgtgggttcggacgggtacggaaacaaggcgtacgaccgtacgtgttacgacgacccgaacggtcctccggtccccgtacggttcctaaccttccgttccccg

SEQ ID NO: 302231 - DNA, 551 bp, Homo sapiens
  misc_feature: GZ8MTXP01D77Q5.52.78.H01.1.454.CMB.2.raw
  modified_base (280)..(280): a, c, t, g, unknown or other
  misc_feature (280)..(280): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtacagcagagcagcaggccctatgtnatatataagacatgagagcctcaggactcctgagcgattcctctggcctcctcctacgagggaacaaacgacgtacaacgttgattcatcaggtaggagtccggnaggaggacgagctgactattaacngtacaatcgaacagacagtagttgtaacttatgtgcgaggttcggcgggaacgggaccaaaggtcgtacggttaacccgttccgttaaacgggtccaaacggtccccgaaggccgttaccgcccccgttcgggttaaccccg

SEQ ID NO: 302232 - DNA, 666 bp, Homo sapiens
  misc_feature: GZ8MTXP01A7KNM.52.78.H01.1.454.CMB.2.raw
  modified_base (301)..(301): a, c, t, g, unknown or other
  misc_feature (301)..(301): n is a, c, g, or t
  modified_base (485)..(485): a, c, t, g, unknown or other
  misc_feature (485)..(485): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgaccaaagcaatagtggttattcggtaccagcagacggccacggaccacggtcccccttagttcgggtanaacttaataaagtaaacggaccctaagtacggaacggacggtaccccgtacggaacggggtaccttaccccggttaggaaccgtcggtaactttccccgtcgttcggtcccttcccgttacccgtacgaacgggaacaaacgtacgtacctacgttgactactatcgaggtggacgggccgganaggacggacgagctaggtacttattagtctaacgtaactacaaacgagaacagtagtaaggttacttagtcgtaggtcgtaaggttcgggacggttacggaaccgaagtcgtaacgttacccgttcgttacggtaaccgcggaacccgaacggtcgttaccccgtccccgttcggttcccg

SEQ ID NO: 302233 - DNA, 696 bp, Homo sapiens
  misc_feature: GZ8MTXP01A2EWS.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattgtacagcagaggccaggccacggtcccccttagttcggtgaactatagtaaacggaccatggacgacggccctacgagggtactcccgtagacgcgtattcgtcgtcggccttccgtccgtacgtaacgggaaacaacgcgtacgtacgttagactacatcgagtcggtacggtccggacgaggacggacggacggctaggtaacttaacgttacgtacggtactaaacttacgaaaccgtagtaaaccgtaagtttaaggttaggtaaccgtttaggtaccgttaggtacgtaacgggtttccggggaacggggtaacggggaaacccgttaaggtaccggttaccggtaacccggttaccggttaacgggttcgaacccggttaacccgaaacgggtcccgttcccgggtacccccgttccggggtaacccttccgtttccccgg

SEQ ID NO: 302234 - DNA, 633 bp, Homo sapiens
  misc_feature: GZ8MTXP01AKSHT.52.78.H01.1.454.CMB.2.raw
  modified_base (222)..(222): a, c, t, g, unknown or other
  misc_feature (222)..(222): n is a, c, g, or t
  modified_base (364)..(364): a, c, t, g, unknown or other
  misc_feature (364)..(364): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagctaatatggttatcggtaccagcagacggccgacggccacggtcccccttagttcggtagatatagtaaacggaccatgagtacggccctacgaggactcccgtagacgcgtattctcgtcggctcncctcgaggtaacactgtcacgttgatcagtcaggtggacggtccgggacgacgggaggacggaacgggcgtagtaacgttacttacgtgtaacaagtacaaacgaacgtacgagttagtaggttacttagtggtacgtcgtaagggttcgggcggggaaacggaccgaaacggtccgttacggtacccggtaaccttaggggccaccgggaacccgtaacggggcccttccccgggcccccgttccgggtaaccttaaccgtttccccg

SEQ ID NO: 302235 - DNA, 641 bp, Homo sapiens
  misc_feature: GZ8MTXP01AZADW.52.78.H01.1.454.CMB.2.raw
  modified_base (372)..(372): a, c, t, g, unknown or other
  misc_feature (372)..(372): n is a, c, g, or t
  modified_base (492)..(492): a, c, t, g, unknown or other
  misc_feature (492)..(492): n is a, c, g, or t
  modified_base (545)..(545): a, c, t, g, unknown or other
  misc_feature (545)..(545): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacggaggactcaccatggagttggggctgagctgggttttccttgttgctattttagaaggtgtccagtgtgaggcgcagctggtggagtcgtgggggaggcttggtccagccgtgggggtccctgacactctcctgtgtacgcctctggattcacctttaacagtatggatgacgttcgggtccgccaggctccgaggggagggctggagtgggtgccagcgtgaagcatggatgggaggtgaaggaanactaagtggccggactcgtggtagggaacggggccgtatttcccgaaccctactttaccgaaggaacgtaaacaaccatacaaaggaacctacgaatgtacttacctaaccaaaatgganccgaagtccctaggaaaccacgttcccggaagggacctacccgggtcccgttntttaagttacctaggttcggaaacgtaggttaggtttttccgtttagggggaattggttttaacggtcccgttaggccctaacccttggggtcccc

SEQ ID NO: 302236 - DNA, 535 bp, Homo sapiens
  misc_feature: GZ8MTXP01E4KK7.52.78.H01.1.454.CMB.2.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (490)..(490): a, c, t, g, unknown or other
  misc_feature (490)..(490): n is a, c, g, or t
  modified_base (513)..(513): a, c, t, g, unknown or other
  misc_feature (513)..(513): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtggggggagcgttggtccagccgtggggggtccctgacnctctctgtgtagcctntggattcacctttaanagttatggatgacttgggccncaggctcgagggagggctggagtgggngccagcgtgaagnatgatggaggtgaggaanactanggcggatctggngaagggcatcacactcagagacaacatacaaagactacaatgtactacgtaacaaaagtgaacgcaacgcctagacacgtaccgaggaccgacggtccgtagttatacgngtgacgagttagttcgttaaggnttggtgtcgttatcgaactcgg

SEQ ID NO: 302237 - DNA, 720 bp, Homo sapiens
  misc_feature: GZ8MTXP01AE53A.52.78.H01.1.454.CMB.2.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaattatggttattggtaccagcagagcaggcacggccccttattggtnatatataagaccatgagcgcctgaggctcccgngagcgtattcgtctcggcctctccgtacgacggtaaacaacgtcgtcacgttgactctatcgaggtggacggtccgggacgaaggtacgggacggacgggtcgtacggtaacttacgtttacgtacgtactaaactaccggaaaacgtaacggtaaccgtaaagggtttaaggttaccgggtttaaacgttttacggttaggtttaacggtacccgggttaaggggtttacccgggggaaccggggttaaacggggaaacccggttaaacggttaccggttacccggttaaaccccggtaccgggttaacgggttacccgaccggggtaaccccgaaacggggtcctaacccccgggtccccccgttacggggttccccttaaccgttttcccccccggg

SEQ ID NO: 302238 - DNA, 713 bp, Homo sapiens
  misc_feature: GZ8MTXP01AL1BF.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggactcacctgctctggagatgcactgaccaaagcaattatggttattggtaccagcaggacgccgacggccacggtacccccttagttcggtagtataataagtaaacggaccaagtgaggacggccctacgacgggactcccgtgacgcgtacttccctctcggtcctaccctcctacgacgggaaccaacgtacgtacgtacgttgactaccgtaatcgtaacggtcgggtaacgggtcccggggacgaaggggaacgggtaacgggacgggtacgttacggtaacctttaaagttacccgttagggttaacgaaacttaaccgtaaaacccgaagggtaaaccgtaagggtttaaccggtaggtttaaaccgtttacgttgggtacgtacggtaacggggttccggggcgggaaacggggtaaccgaaacggtcgtacggttacccgttccggttacgcgacgaacccgaacgggccttcccggtccccgttcggtaacccg

SEQ ID NO: 302239 - DNA, 524 bp, Homo sapiens
  misc_feature: GZ8MTXP01D4QPS.52.78.H01.1.454.CMB.2.raw
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgacaaagcaatatggtattgacagcagagcaggcagccctagtgngatanataagacatgagtacgcctacgaggactcctgagcgtattctcgtcggctccgtcctcgaacggaaaccaacgtaagtctacgttgactcatacgagtggacgtccgggcaggagacgagctagactatactgactaactanaaacagactagtagtgtacttagagtncgtaggtcggcgggaaggtacaggcttcgacgtcgttagttcgacgaaccgaggcctcgcccgttcgtcaacgttcc

SEQ ID NO: 302240 - DNA, 720 bp, Homo sapiens
  misc_feature: GZ8MTXP01BX6C6.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctgganatgcactgaccaaagcaatagttggttattggtacagcagaggccaggccacggtccccttagttcggtagaatataagtaacggaccagtaggaagacggcccgtacgacgggactacccgtagacgcgtacttcctccgtggtccctccctccgtaacgaacgggaaccaaacgagttaccaacgggtttcactacctaatccgtaaggtgggtaaccgggtcccggggagaaacgggtaacggggaccggtaaggtcgttacgaaccgtttaagtttacgttacggtaacgtaaacgttaccaaacgaacgtaacgtaaaggttacgttaacgggtttaactttaacgtgggttaacgcggttaaacgggttccggggaaacggggttaaccgggaacccaaggtaccgtacggttaacccggttccggttaacggtaaccgaccggtaacccgtaacggtccgttccccgtaaccccgttcgggttaacccc

SEQ ID NO: 302241 - DNA, 536 bp, Homo sapiens
  misc_feature: GZ8MTXP01BQ5VL.52.78.H01.1.454.CMB.2.raw
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtaccagcagaggccaggccacggccccttatcggtnatatataaaggaccatgagacggccctacgagggactcccgtgacgcgtattcctcgtcggcctcctcctacgaggaaaccaacngtcacgttgatcatcgtagnggtaggtccggngaggaggacgaggctggactattactgataatacaaanagaactagtagtcgtattntagtgtgtagtcggngaagggacagtcngctcgttagttcgacgtccagctccgcccttggtccttcgtcccg

SEQ ID NO: 302242 - DNA, 687 bp, Homo sapiens
  misc_feature: GZ8MTXP01A6ZQH.52.78.H01.1.454.CMB.2.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (607)..(607): a, c, t, g, unknown or other
  misc_feature (607)..(607): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctgggtggagtcgtggggggagcttggtccaggccgtggggggtccctgacactctcctgtgtagcctctggattctacctttaacagttattggatgacgttgggtccncgaggctccgaggggaaggggctgggaggtggggtggccaggcgtagancagtgagtgggagtggaaacggagaacgtagtcgacggtacgtcgttgggtaggaaccgggggcctatttacccgaaccttaccgttaccaagggaaccaacttaaaccattaacccgaaaagtaacctacgaaattcgttaaaccctacgtaaacctaaagtgaacgtaccacgttcccgtaagaacccgtacggtacccgggaacgtaacccggtccgggttaacgttacgttaacgttcggngggttacggacggttagggtttcgttttacgggtgggttactttgggttacggttccgttacgaacccgttaaccggtcg

SEQ ID NO: 302243 - DNA, 561 bp, Homo sapiens
  misc_feature: GZ8MTXP01CWSPF.52.78.H01.1.454.CMB.2.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
  modified_base (453)..(453): a, c, t, g, unknown or other
  misc_feature (453)..(453): n is a, c, g, or t
  modified_base (549)..(549): a, c, t, g, unknown or other
  misc_feature (549)..(549): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattgtacagcagagcaggcacgccccttatgnatatataagacatgagacgcctcgagggactcccgtgagcgtattctctcggctcctctcgagggaacaacngtctacgttgactcatcgaggtggacggtccgggacgaggaggacggaggctgaacttattactgtacaatacaaacagaactagtagtaggtacttagtgngtcgtaggttccgggaggaacgggaaccaaggtccttcggtaacccgtcgttaacggcgacgaacccgaacggccgtaccgcccccgttcggtccnccgtttaacccg

SEQ ID NO: 302244 - DNA, 697 bp, Homo sapiens
  misc_feature: GZ8MTXP01BP7PX.52.78.H01.1.454.CMB.2.raw
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggcttggtccaggccgtggggggtcccctgacactctcctgtgtagcctntggattcactttaacagttatggatgacttcgggtccnccaggctccgagggaaggggctgggagtgggtgccagcgtagaagcatggactgggaaggtggaaggaaacgaactaatggacgggtaactcgtagggtagggaaacgggggtccctaattacccaacccgtaactttaccccgaaaggaacgtaaacaaacctaaactaactaaacgtaaactaactaaacgttaacgttaacttaccgtaacctaaacgtaacgaacgacgacgtaccgtacgtaacgtaacgtaaccggaacggaaccggacggtaaccggttacgttacgttacgttacggtacggtacggttacggttacggtttacggtttaagggttaggtttcggtttcggttcggttacgtaaccgttaacgtaacg

SEQ ID NO: 302245 - DNA, 666 bp, Homo sapiens
  misc_feature: GZ8MTXP01BQCQ2.52.78.H01.1.454.CMB.2.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatattggttattggtaccagcagaggccaggccacggtccccttagtcggtntaataataagtaaacggaccagtaggaacgacggccctacgagggactcccgtagaacgtcgtactttcccgtcgtcggtccctccctcccgtaacgaacgggaaccaaacgtacgtcctaacgttgactcactcgtaggtgggtacggccgggacgaagggacggacggaaggtcgtacggtaacctagtttaacgtcggtaactaaacgttaacgaaaccgtaagaacgtaaggttaggttagtttaaacgttagtcgtacgtacggtagggttcggggacggaacggggaacaggtccgtacggttacccgttcgagggtaaccaccggtaaccggaacgtccgttcccggtccccgttaacggttccc

SEQ ID NO: 302246 - DNA, 666 bp, Homo sapiens
  misc_feature: GZ8MTXP01B3ZZQ.52.78.H01.1.454.CMB.2.raw
  modified_base (329)..(329): a, c, t, g, unknown or other
  misc_feature (329)..(329): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggtattggtaccagcagagccaggccacggccccttattcggtnatatataaggaccagtgagacggccctacgagggaactcccgtggacgcgtacttcctccgtcgggtccctcccttccctcgaacgggaacaaacgacgttactaccgtttagactaccaagttccgaaggttacgggacggtccggggggacgaagggaacgggaaaccggaggtcgtacggtaactttaacgttaacttcggtaacctaaacttaccgaaaacgtaagttaaccgtaaggttaggttacgggttaaccttttaaggttgttacggtaacgttagggttaaccggggtacgggtaacggggttaccgaaacggccgttaacccggg

SEQ ID NO: 302247 - DNA, 714 bp, Homo sapiens
  misc_feature: GZ8MTXP01CPHP0.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtgggtggagtcggtgggggaggtcgttgggtccaggccgtcggggggtccctgacactctcctgtgtacgcctcgtggattctacctttaacagttattggaattgtacgttcgggtccgccaggcctaccgaaggggaaggggcgtagggaggtgggggtcggcccaaggcgtagaaagcagtgagtgggaggtggaacggaagaacttagtcgggacgggtaacttcggtaggtacgggaaacgggggcctaacttacccgaacctaaccttacccgaaaggaaccgaaaccaaactaaacttaacaaacggtaaacctacgtaaaattcgttaaactacctaaacccgtaaaagttcgaaacgaccgaacgacccttagaaaccctacgtacccggaacggtaacccgaccgggtccgttagttaacgtttacggttgtacggtcggttaaggttcgttttcggtttaaggggtatttgggtttcggtacgttcgccaaccgtcg

SEQ ID NO: 302248 - DNA, 685 bp, Homo sapiens
  misc_feature: GZ8MTXP01EJUID.52.78.H01.1.454.CMB.2.raw
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggaggcttggtccaggccgtggggggtccctgacactctcctgtgtacgcctgtggattcacctttaacagttattggatgacttggtccncgaggctccgagggagggctggagtgggtgccagcgtgaacgnagtgagtgggaggtaggaaggaagaactagtcggacgtacgtcgtaggtacgggaacgggacctacttccaacctactaccgaagaacgaaacaaacaactaacaaacgaactactaattacgttaactaccgtaaactaaagtacgaacgaccgaacgtaccgtacgtaaccgtacgtacccgggaacggtacccggaaccggttaaccgtttaagttaacgttaccgttagggtacggtaacgggttacggtttacgggttttcgggtttaaggggtacgttttcgggtttacggtttaccggttacggtaacccgttaacccggtaacg

SEQ ID NO: 302249 - DNA, 752 bp, Homo sapiens
  misc_feature: GZ8MTXP01BH5G8.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtcgtcctcaggacagacggccaggatcacctgctcgtggagatgcactgaccaaagcaatagttggttattggtaccagcaggacggccgaggcccacggtcccccttagttcggtagtatataagtaaacggaccagtagagacggacccttacgaggtactcccgtgagcgtattcgtcgtccggtccttcctcctacgacggaaaccaacgtgtcgtaaccgttgactacagtaccgagggttacggacgggtacccgggacgaagggacgggaacggtacgggtacgtacgtaaccgttaactttacgtacggttaactaaacttaaaccgggaaacgtaacggtaaaccgtaagggtttacggttaaccggtttaacgtttaggtacgggttacggttaccggtaacggggtttccgggggaccggggtaaacgggtaacccgaaacggggtcccgttaacgggtaaaccccggttaccggttaaccgggttaccgttacccgggaacccgtacgggtcccgtcccgggtcccccgttacggtcccttaacccgtttcccccg

SEQ ID NO: 302250 - DNA, 818 bp, Homo sapiens
  misc_feature: GZ8MTXP01D9QXQ.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaattagtggttattcggtaccagcagacggccacggccacggtcccccttaagttcggtagtaatagtaataaacggaccagtaggaacgacggacccgtacgacgggtactcccgtaggacgtaccggtaatttcccgtcgttccccgggtcccttacccgtcccgttaaccggaaccgggtaaaacccgtaaaccgtaacgggttaacccgtaaacccgggttttaggaaaccttaccgtaacgttaacccggtaagggttaccggggtaacgggttaccccggggagaaacggggtaacggaacgggtacgggtacgttacgtaaccgttaagttaccgtaggtaactaactaacgaaacgaaagtaccgtaaggttaacgttacgaacgttttttacgagggtctacgggtacggtttccggggacggggtaaaccgggaaccttaaacgggtccgttaacccgggtacccgtttaaccgggttaaaccgggttcgaacccgggttaacccggaaaccgggtccccgtttccccggacccccggttcgggttaaccccttccgttttaaccccccggg

SEQ ID NO: 302251 - DNA, 643 bp, Homo sapiens
  misc_feature: GZ8MTXP01B57EJ.52.78.H01.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (610)..(610): a, c, t, g, unknown or other
  misc_feature (610)..(610): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacactctcctgtgtagcctntggattctaacctttaanagttattggatgacgttcggtccgcaggctccgaggggagggcgtggagtgggtcgcagcgtagagcagtgagtgggaggtgaagggaagtaacgttagtcggacgggtacttcgtggtagggaacggggcctaacgtttcccaaccctaaccttaccgaagaacgaacaaactataacgaaagaactacaaattgtaactacctaacctaaaagttcgaacgccaacgtccctaggaaaccctcgtaccccgggaaggacccgtacggtcccgttagttacttacggttggtacgacggttagttcgtttcggtttaagggntttgggtttacgtcggttacgcccttaacgtcg

SEQ ID NO: 302252 - DNA, 553 bp, Homo sapiens
  misc_feature: GZ8MTXP01EFGZS.52.78.H01.1.454.CMB.2.raw
  modified_base (383)..(383): a, c, t, g, unknown or other
  misc_feature (383)..(383): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (546)..(546): a, c, t, g, unknown or other
  misc_feature (546)..(546): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattgtacagcagaggccaggccacggcccccttaattggtgatatataaggaccatgagaggccctgagggactcccgtgagcgtattctcgtccggcctcctcctcgacgggaaaccaactggtctaaccggttnactccagtcgaggttggacgtcgggacaggaggacgaggctagactattacgtgacaatacaaacaggtacagttagtagttactaagtgtntgtaggttcggnggaaggaccaaggccttagaccgtcgagttcacgccgagcctccgccccttggtaaccncgttccc

SEQ ID NO: 302253 - DNA, 784 bp, Homo sapiens
  misc_feature: GZ8MTXP01EP587.52.78.H01.1.454.CMB.2.raw
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagcccaccctcggtgtcagtgtcctcaggacagacggccaggatcacctgctctggagatgcactgaccaaagcaatatggttattggtaccagcagacggccaggccacggtccccttagttggtgatataataaagaccatgagacggccctacgaggactcccgngacgcgtattctcgtcggtccttcctccgtcgaacgggaaacaacgtaacgtactacgggttanactacgatacgtaggttacggggtaccgggttcccggggaacgaaggggaacgggaaccgggtaacggtaccgttaagggtaacccgtttaatttaacccgtaggttaaaccgtaaactttaaaccggaaaacgtaacggtaaaccgttaacgggtttaaggttaaccgggttaacttttaaagttgggttacgtacgggttaacggggtttacccgggggaacggggaaacggggtaaacccgttaaagggtacccgttaccgggtaaaccccggtttaccggttaaccgggttacccgaaacccgggaaccccggtaaaccgggtcccgttcccccgggtaccccccggttccgggttaaccccttaaccccgttttccccccggg

SEQ ID NO: 302254 - DNA, 630 bp, Homo sapiens
  misc_feature: GZ8MTXP01AL6MS.52.78.H01.1.454.CMB.2.raw
  modified_base (296)..(296): a, c, t, g, unknown or other
  misc_feature (296)..(296): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgaccaaagcaattatgttattggtaccagcagaggccaggccacggccccttagtggtgatatanaagacatgagcggcctacgagggactccgtgacgcgtattcctctaggtccctcctcctaacgacgggaacaacgcgtactacgttgaactcactcgtaagtgggacggtcccgggagaagggaacggggaccgagggtccgtaggtacttaacgtttaccgtagttaaccaacgttaacaaaccgtaagtaaaccgtaagtacggttaagttaccttagtaggtgaccggttaggttccggggacgggaacgggtaccacgggtacgtacgttacccggttccgttaggtaaccgacgaacccgaacgtccgcccgtcccccgttcggtcccc

SEQ ID NO: 302255 - DNA, 654 bp, Homo sapiens
  misc_feature: GZ8MTXP01CBZ2E.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcacggccacggtccccctttagttggtagtatatagtaaacggacaatgagacggccctgagggactcccgtgagcgtattccctctcggcctcccgtcctaacgaacgggaacctaaacgtacgtacctagtacgtactcgatacgaggtaggacggtcccgggagaacggaggacggaggtactaggtaacttaacgttacgtacgtacaacttacaacgtaacgtacgtaagtacggttagggttaaccttgtaggttcgtacgttgggttaacgggaacgggttacgggtaaaccggaagtccgtacggttacccgttcggttacggtaaccgaccggtaacccgtaacggtcccgttccggtccccccgttaaggttccccg

SEQ ID NO: 302256 - DNA, 686 bp, Homo sapiens
  misc_feature: GZ8MTXP01A0DGN.52.78.H01.1.454.CMB.2.raw
  modified_base (284)..(284): a, c, t, g, unknown or other
  misc_feature (284)..(284): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaatatgttattggtacagcagagcagccacgcccttatggtnatatagtaaggaccatagagacggcctacgagggactccgtgacgtcgtactttcctcgtcggtcctcccgtcctacgaacgggaaccaaacgtacggtccgtaacgtttggaactctaacgtaccgaagggttcgggaacgggttccgggaccgaaagggaaacggggacggacgggtacgttacgtaaacgttaagttaaccgtaggtaaccgtaaaacttaccgaaaaccgtaacgtaaccgtaagttacggttagttaaacgttaggttacggtacgtaacgggttacgggttaaccggggaacggggttaacgggaaaccgacggtacggtaccgttaccggttcgttacggtaacgaccgaaccgacggtccgttccccgtaaccgttcgttcccg

SEQ ID NO: 302257 - DNA, 719 bp, Homo sapiens
  misc_feature: GZ8MTXP01DVGN3.52.78.H01.1.454.CMB.2.raw
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccacctcggtgtcagtgtcctcaggacagacggccaggatcacctgctctggagatgcactgaccaaagcaatatgtattggacngnagagcagcacggtcccctattcggngatatataagacatgagacgcccgtacgagggacttccgnggacgcgtattctcgtcggccttccgtcctaccgaggggaaaaccctaacgtcgtacctaacggttacggtacttaccgaagtccgtaagggtcgggtaaaccgggttcccggggaccgtaaggggaacggggacggtaacggggtcccgttaaggtaacccgtttaaggttaacctcgggttaaccgaaactttaaccggaaaacgtaacggtaaaccgtaaaggttaggttaaccgggtttacttaaagttggtccggtaccgttaggggtttccgggaccggggaaacgggtaacccttaaacgggtccgttaacggtacccgtaccggttaacgttcgacccggccgaacggtcccgtacccggccccgttacgggtccttaaccgtttccccgg

SEQ ID NO: 302258 - DNA, 796 bp, Homo sapiens
  misc_feature: GZ8MTXP01EYMFM.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggagtcgttggtccgagccggtgggggtccctgacacgtctcctgtgtacgcctcgtggtattccgtaacctttaacgagtttagttggtatcggtaccgtttcgggtccccgtccgaacggtcccgttacccgggaaggggggaagggggtccgttagggggtaacgggttgggggtcggaccccgtaggtaccgggtagaagcgtaagtaggacgttagggggaggtacggaaagggtaacgtaaacgttagtcggaccggtaacgtcgtgggtaacgggacgggggtccctaaacgttccctaaacccgtaccgttaaccgagaaaccgaaacctaaactaacgttaaccaaaacgtaacctaacctaagttacgtaacttaccctaaacgtaaaagtcgggaacgtacgaaccgtccgttaaacggcctaacggtacccgggaaggacccggtaacccgggtccgttaagtttaaaccgtcggttgtcgggtaccggttaggttttcggtttaccgggtttgggacgtttttggtttccgggtcgtttacgaacccgttaacccgttccgg

SEQ ID NO: 302259 - DNA, 754 bp, Homo sapiens
  misc_feature: GZ8MTXP01CBZGH.52.78.H01.1.454.CMB.2.raw
  modified_base (296)..(296): a, c, t, g, unknown or other
  misc_feature (296)..(296): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctctcactctctgcacaggctctggggcctctatgaactgacacagccaccctcggtgtcagtcgtcctcaggacagacggccaggatcacctgctctggagatgcactgaccaaagcaatattggttattggtaccagcagacggcaggccacggtcccccttaagtcggtanaatatagtaacggaccagtgagacggccctagacgggtactcccgtagacgtacgtatttccccgtcgtcggtcccttcccgtccctaacgaacgggaacaaactaggtaccttaacggtgtactaccgataccgtagggtacgggacggtcgggcaaggggaacgggaccggagggtccgttaggtacttaaacgttacgtacgttaacaaacgtttaaccgaaaccgtaaaggtaaccgtaaagggttaacggttacggtttaaacgtttaacgttaggggttcgtaccggttaacgggtttccgggggaacgggggttaaacgggggtaaacccaaaggggttacccgtacggttaaccccggggttcccgttaacggggttaaccaaacccgggaaccccgttaaaccggggccccgttaccccggtcccccccgggttcgggtttaacccccg

SEQ ID NO: 302260 - DNA, 682 bp, Homo sapiens
  misc_feature: GZ8MTXP01B0VES.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatattggttattggtaccagcagaggccaggccacggtcccccttattggtgatatataaggaccatgaagacggccctcgagggactcccgtgacgcgtattcctcgtcggtcctccctccgtacgacgggaaccaacgacgtacgtaccgttagacgtacatacgtaggttcgggacggtccggggacgagggaacgggacggaggtccgtaggtaacttaagtttacgtacggtactaaacgttaccgaaactacgaacgtacggttagtagggtttaaccttaagttcggtagtacgtacgggttcggggacggggttaacgggaaccgttaagtaccggttacgttaaccccggttacggttacggttaacccggaaccggtaaccccggtaaacgggcccgttccccggtccccccggttccgggttaaccccg

SEQ ID NO: 302261 - DNA, 606 bp, Homo sapiens
  misc_feature: GZ8MTXP01E3YCG.52.78.H01.1.454.CMB.2.raw
  modified_base (364)..(364): a, c, t, g, unknown or other
  misc_feature (364)..(364): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtaccagcagaggcaggccaggcccccttattggtgatatataaaggaccatgagaggccctcgagggactccctgagcgattcgtctcggcctcctcctcgacgggaaacaacngtcacgttgatcatcagtggagtccgggcagaggacgagggctagacttatactgtcaagtcatcgagacagacgagtggactacgttaatcgtacgttaggttaaccgggacgggttaacgggaaacccgttaaacgtcggtaaccccggttcggttaacgggttacccgaaccggaaccccgtaaacgggtccccgtacccgacccccccgtttcgggggttaacccctttaacccccgg

SEQ ID NO: 302262 - DNA, 822 bp, Homo sapiens
  misc_feature: GZ8MTXP01AGA6L.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactacgaccaaagactaattagttaggttattacggtaaccagacaggacgccgacggccacggtccccttagttcggtagataataagtaaacggaacctagtacggaacggacggtacccgtacggagggtaccttcccgaggacgtcgtactttccgtcgtccggtcctccgtccgtacgaacgggtaaaccaacgtaacgtacgtacggttgaactcgtacgtacgtagggtcggtacgggtacccgggaaggaacgggaacggaaccgggtacggggtacccttaaggttaaaccctttaagttaaccggttacgttaaactaaaccgttaaacgaaaacggtaaaccggttaacgttaaaggggttttaaggttaccgggttttaaacttaagggttcggtacgtaccgggttaacggggtttaacccgggggacggggtaaacggggtaacccgaaacgggtcccgtttaaccgggaaccccggttaaccggttaccgggttaccgttaaccccgggtaaccccggaaccgggtccccgttaccccgggtacccccgtttaccgggtcccgttaacccgttttcccccgg

SEQ ID NO: 302263 - DNA, 618 bp, Homo sapiens
  misc_feature: GZ8MTXP01BIDZD.52.78.H01.1.454.CMB.2.raw
  modified_base (221)..(221): a, c, t, g, unknown or other
  misc_feature (221)..(221): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatggttattggtaccagcagaggccaggccacggtccccttagtggtgatatataaaggaccagtgagacggcctcgaggactcccgtgacgcgtattctcgtcggtcctcctcctcgacgggaacaactgtctacgtgactcatcgaggtcgacggtccggacgaggtaggtacggacggtactacgtacttagttacctgtaactaactacaaactagaactagttagtacggtacttagtcgtgtacgtacggttcgggacgggaacgggtaaccgaaacggtcgttaccggtaacccgttcgttaacggttcgaccggtaacccgaacgggtccgtcccggtcccccggttcggtccttaacccggtttccccg

SEQ ID NO: 302264 - DNA, 633 bp, Homo sapiens
  misc_feature: GZ8MTXP01BA4XP.52.78.H01.1.454.CMB.2.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (372)..(372): a, c, t, g, unknown or other
  misc_feature (372)..(372): n is a, c, g, or t
  modified_base (578)..(578): a, c, t, g, unknown or other
  misc_feature (578)..(578): n is a, c, g, or t
  modified_base (608)..(608): a, c, t, g, unknown or other
  misc_feature (608)..(608): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggagcgttggtccgagccgtgggggtccctgacactctcctgtgtancctntggtacttctacctttaacagttatggatgtacgttcgggcccgccgaggccgtccggaaggggaggggctgggaggtgggtcgccgagcggtagaacgnagtgagtgggagtgaaggaagaacgtagtcggcgtactcgtaggacggaacgggcctacttacccgacctacttaccgaagtacgaaacaacacgtaacaaacgtaaactactaaattacgtaactaccggtaacaaagtcgacgacaccggactacgaaaccgtcgtaccgggaacgaccgaccgggtccgttagttacgtacgnggtacgagttagttggtttcgttaagggtnttggttgtcgttcgccgttaacgcg

SEQ ID NO: 302265 - DNA, 665 bp, Homo sapiens
  misc_feature: GZ8MTXP01E1XKH.52.78.H01.1.454.CMB.2.raw
  modified_base (652)..(652): a, c, t, g, unknown or other
  misc_feature (652)..(652): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagctaatatggttattggtaccagcaggaggccaggccacggccccttagttggtgatataataagaccatgagacggcctacgaggctcccgtgacgcgtacttctcgtcggccttcctccgtacgacgggaaaccaaacgtcgtaccgtaacggttagactacctaagttcgagggttacgggacgggttcccgggagagggaacgggacggtaagggtcgttacgtaacgttaacttaccgttagttacaaacttcgaaacgtagaactaggtaacgttaggttaaattgtagtcgtacgtacggtcgggaacgggaacggaacgttacggcgttacggacccgttaccggttacggttccgaacgggtaaccccgaaggtcccgtccccggtccccgttcgggttaaccccnccgtttcccccgg

SEQ ID NO: 302266 - DNA, 614 bp, Homo sapiens
  misc_feature: GZ8MTXP01B6A2I.52.78.H01.1.454.CMB.2.raw
  modified_base (403)..(403): a, c, t, g, unknown or other
  misc_feature (403)..(403): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatattggttatggtaccagcagaggcaggccacggccccttatcggtgatatataaggaccagtgagacggcccctagacgggactcccgtgacgcgtattcccgtctggcctcctcctacgaggaacacacgtcagttgatcatcgagtggacgtcgganaggagggacgaggcgtagaacttattacgtacgtacaaagttacaaacgtacgaactaggttagttagggttaaactttgtaggttcgtacgtagggtttaacggggcggggttaaagggtacccgaagtaccggtcggttacccggttcgttaacgggtccaccggtaaccgaacggggtcccttccggtcccccgtttcggtaaccccg

SEQ ID NO: 302267 - DNA, 587 bp, Homo sapiens
  misc_feature: GZ8MTXP01A4DCB.52.78.H01.1.454.CMB.2.raw
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
  modified_base (542)..(542): a, c, t, g, unknown or other
  misc_feature (542)..(542): n is a, c, g, or t
  modified_base (562)..(562): a, c, t, g, unknown or other
  misc_feature (562)..(562): n is a, c, g, or t
  modified_base (586)..(586): a, c, t, g, unknown or other
  misc_feature (586)..(586): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtagcctctgattcacctttaacagttatggatgacgttggccncaggctcgagggaggctggagtgggngccaggcgtgagcatggactgggaggtggaaggagaactagtgacgggtactcgtggtacggaacggggctagttcccaaccgtacttccgaagacgaacaaaccgtatacgaaaagtacctactaaaagtntaacctcgtaaacctaaagtgacgacacgcctagaaaccncgtaccggaagaccgtaccggcgttgttactagttgtacgngttagttggttcgttaaggnttgttgtacttcgccgttaaccgng

SEQ ID NO: 302268 - DNA, 713 bp, Homo sapiens
  misc_feature: GZ8MTXP01ESQU8.52.78.H01.1.454.CMB.2.raw
  modified_base (258)..(258): a, c, t, g, unknown or other
  misc_feature (258)..(258): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgagatgcactgaccaaagcaatatggttattggtaccagnagaggccaggccacggccccttagtggtgatatataacggacatgagagccctcgacggtactcccgtgagcgtattctcgtcggcctcctccgtcgacgggaaacaacgcgttcgacgttgactactacgtcaaggtcgggaacggtccgggacgagggacgggacggacggtacgtacgtaacctttagttaacgttacggttaactaaacttaaccgggaaaacctaagggtaaaccgttaaagggttaccggtttaacggtttaacgtttacggtttagacgggtacggttaacgggtttaccgggggaccggggtaaaccggggtaacgaacggtaccggttaccggtaacccggttaccggttaaacgggttccgaacccgggtaaccccgaacggtccccgtccccggtacccccggttcggtaaccccgttaacccgtttcccccgg

SEQ ID NO: 302269 - DNA, 584 bp, Homo sapiens
  misc_feature: GZ8MTXP01D31PQ.52.78.H01.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (427)..(427): a, c, t, g, unknown or other
  misc_feature (427)..(427): n is a, c, g, or t
  modified_base (495)..(495): a, c, t, g, unknown or other
  misc_feature (495)..(495): n is a, c, g, or t
  modified_base (565)..(565): a, c, t, g, unknown or other
  misc_feature (565)..(565): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgagttttccttgttgctattttagaaggtgtccagtgtgaggcgcagctgggtggagtcgtggggggagcttggtccagccgtggggggtccctgacactctcctgtntagcctntggntcacttaanagttatgatgacgttggtccgccaggctccgaggggagggctggagtggggtgcaggcgtgaagcagtgagtaggaggtgaaggaaagactaagtgcggactcgtggtaggaacggggcctattaccaacctacgtccaagganaaaccaaactataccgaaaagaaacctactaaatcggttaactacctaaccgaaaagttcgagaccgngaccctagaactacgtacgacgacgaacgtccgttagtaccttagcgtagcggattacgttgtagggttnttggtgttcgtcgcgaacg

SEQ ID NO: 302270 - DNA, 626 bp, Homo sapiens
  misc_feature: GZ8MTXP01CVIOX.52.78.H01.1.454.CMB.2.raw
  modified_base (320)..(320): a, c, t, g, unknown or other
  misc_feature (320)..(320): n is a, c, g, or t
  modified_base (396)..(396): a, c, t, g, unknown or other
  misc_feature (396)..(396): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
  modified_base (611)..(611): a, c, t, g, unknown or other
  misc_feature (611)..(611): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgagcgcagctgggtggagtcggtggggggaggtcgttggtccaggccgtggggggtccctgacactctctgtgtacgcctctggtacttctaacctttaacagtttatggatgacgttcgggccncgaggcctcgaggggagggctgggaggtgggtggccaggcgtagagcatgagtgggaggtggaaggaagaactagnggccgacttcgtaggtaggaacggggtcctattcccacctactaccagagaacctaacntaacaagactaacagttctatcgtaaacaaggtnacgacacgtccacggaactacgtacccgggaaaggcccgaaccgggtcgtttacgttaaacgtttcttgggtacgtacggttaggttacgttttggttgggtagtttcggtttagtcggttncccgaacccgtaagg

SEQ ID NO: 302271 - DNA, 611 bp, Homo sapiens
  misc_feature: GZ8MTXP01CQJW5.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcactgctctggagatgcactgaccaaagcaatatgttatgtacagcagagcagccacgccccttagtgtgatatataagaccatagagacggcctacgaggactcctgagcgtacttcctcgtcggtcctccctccgtaacgacgggaaccaaacgtacgtacgtacgttagactacgtatcgaggtggacgggtcggcgaagggaggacggaggtctaggtacttaagttacctaggttacgaattacaaacgagaactagtagtacggtttaactagtgtcgtacgtaggttccgggagggacggggaccaacggtacgtacgttacccggttcgttaccgggtaacaacccggtaaccgaacgggccgttccccgtaaccccggttcggttaaccccg

SEQ ID NO: 302272 - DNA, 724 bp, Homo sapiens
  misc_feature: GZ8MTXP01ADDQ5.52.78.H01.1.454.CMB.2.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (623)..(623): a, c, t, g, unknown or other
  misc_feature (623)..(623): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggagtcgtgggggagcttggtccaggccgtggggggtccctgacactctcctgtgtagcctntggattcacttaangttatggatgtacgttggtccnccgaggcctccgagggaagggctgggaggtgggggtcgccaggcgtagaagcgaagtggacgtggggaggtaggaagggaaagtaacttaagtcggacggtaactcgtggtacgggaacggggcctaacgttcccaaccctaccttacccgaagaaccgaaacaaactaacaacgtaaaacgtaacctactaaattacggttaactacccgttaaacaaaaggttcgaaacgacctacggtaccctaggaacctaccgtaccgggaaacggaacccgtaccggggtaacccgttagttaaacgttttacccgggngggtaacggtacggttaagggtttccgggttttcgggttttaagggggttattttcggggtttccgggttcggttaccgaacccgttaacccggtaaccgg

SEQ ID NO: 302273 - DNA, 729 bp, Homo sapiens
  misc_feature: GZ8MTXP01CHFLS.52.78.H01.1.454.CMB.2.raw
  modified_base (644)..(644): a, c, t, g, unknown or other
  misc_feature (644)..(644): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcgaggacagacgccaggactcactgctctggagatgcactcgacaaagctaatagtaggttagttacggtaccagacaggacggccgacggacctacggccccctttagttcggtagtatatagtaacggaccagtacggagacggcctacgaaggtactcccgtagacgcgtattccccgtcgtcggtccttccctcccgttaacggaacgggtaaccgaaaccgtacggtaccgtacggttagtactactactacgtagggttacgggacggggtcccggggaacgtagggaaacggggacggacgggtacgttacgggtaaccttacgtttaaccgtggttaaccgtaaatttaaccggaaacccgtaaggaacccttaaggggtaacgttaccgggtttacttagtaggttcgtacgttacgggttaacggacggggttacggaaaccnggtaccgtagttaccccggttacgaccggttaaccgccggaaccgtaacgtccggttaccccgttcccccggttggttaaccccg

SEQ ID NO: 302274 - DNA, 571 bp, Homo sapiens
  misc_feature: GZ8MTXP01BEICH.52.78.H01.1.454.CMB.2.raw
  modified_base (322)..(322): a, c, t, g, unknown or other
  misc_feature (322)..(322): n is a, c, g, or t
  modified_base (498)..(498): a, c, t, g, unknown or other
  misc_feature (498)..(498): n is a, c, g, or t
tcagcgcagtacgacacgaccggtgctcgatttagtgtgagtagtttgggtttgggcacgaccggtgctcgatttagtgtgagtagtttgggtttggggtgggtccaggaggcagaactctgggtgtctcaccatggcctggatccctctacttctccccctcctcactctctgcacaggctctgggcctcctatgaactgacacagccaccctcggtgtcagtgtcctcaggacagacgccaggatcacctgctctggagatgcactgaccaaagcaatatggttatggtaccagcagagcaggccacgccccttagtgtnatatataagacatcgagacgccctacgagggtaactcccgtgacgcgtacttcctcgtcggtccttccctcctacgacgggacaacgtacgtactacgttgatccgattcgagtaggacgtcgggggacaggacgacggaggctacgacttattacgtacgttacaacgtccaaanaacgactagttagtacggttattagttgttacgcgtaaggttccggacgggacggacgaacgttcgtaaccgg

SEQ ID NO: 302275 - DNA, 678 bp, Homo sapiens
  misc_feature: GZ8MTXP01DBAJH.52.78.H01.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (611)..(611): a, c, t, g, unknown or other
  misc_feature (611)..(611): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagtcttgggttttccttgttgcttattttagaaggtgtccagtgtgaggcgcagcgtgggtggagtcgtgggggagcttggtcagccgtgggggtccctgacnctctcctgtgtacgcctcgtaggtacttctaaccctttaanagtttatggatcgtaacgttcgggtccgcgaggcctccggaaggggagggcgtgggagtgggtcggccaggcgtagaacgcagtgagtggaggtgaaaggaagtaaacgtagtcggacgtactacggtaggtacgggaacggggtacctacgttacccaaccgtacccgttaccgaaagacgaaacccaaatactaacaaaacgtaacttaacgaagttacttaacttccggaaactaaaagtcgaacgacgtaacgtccgtacgaaacgtacgtaccgggacgtaaccgacggtaacgttggttaactttacggngtacgtacgttagtttcggtttcggttaaggttcgtttggttcgtcgttaccgaaccgttaacgtcg

SEQ ID NO: 302276 - DNA, 613 bp, Homo sapiens
  misc_feature: GZ8MTXP01DMF3G.52.78.H01.1.454.CMB.2.raw
  modified_base (399)..(399): a, c, t, g, unknown or other
  misc_feature (399)..(399): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattaggtacagcagagccgaggccaggtcccccttattcggtgatatataaaggaccatgagagaccctgaggactcccgtgagcgtatctcgtcggctcctctcgagggaaccaagcgtacacgttgactacatcagtggaacgtccggganaggacggaacgagtcgtagtacgtaacgttacctggttaacaacgttacgaaaccgtagaaccgtaaggttacgtacgggttaactttagttacggtgtacgtacggtttccgggaacggggaacggtaacccgaggtacgttacggtaccgtcgttacggttcacggtcccgaacggtcgtacccggcccttcggtccttaaccgtttccccg

SEQ ID NO: 302277 - DNA, 688 bp, Homo sapiens
  misc_feature: GZ8MTXP01BABQ5.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctcgtggggcctcctatgaactgacacacgcccaccctcggtgtcagtgtcctcaggacagacggccaggatccacctgctcgtggagatgcactcgaccaaagcaatatggttattggacagcagaggcaggccgacgtccccttagtcggtagatataagtaacggaccagtagagacgtccctacgagggactcccgtagacgtacgtattccgtcgtcggtcctccctccgtacggaacgggacaacgtacgtacgtaacgttgaactacgtacgtacgagggttacgggacggtccgggacgaagggaacgggacggggaacgggtaccggtaagacccgtttaagttacccgtaggtaaacgtaaaccttacgtaaaaccgaacggtaaacgtaagggttaagggtttacggttaaaccgtttaagttgggtacggttaacgttacggggttccggggacgggtaaccgggaccgtaacgggtaccgtacgggttacccgtaacccggtttcggtaaccccggg

SEQ ID NO: 302278 - DNA, 626 bp, Homo sapiens
  misc_feature: GZ8MTXP01D7YN6.52.78.H01.1.454.CMB.2.raw
  modified_base (330)..(330): a, c, t, g, unknown or other
  misc_feature (330)..(330): n is a, c, g, or t
  modified_base (528)..(528): a, c, t, g, unknown or other
  misc_feature (528)..(528): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctggtgtcagtcgtcctcaggacagacggccaggactcacctgctctggagatgcactgaccaaagctaaatagtggttattggtaccagcagacggcaggccacggtcccctaatggtgataatataaaggaccatgagacggcctgaggactccgngagcgtatcgtcgtcggcctcgtccgtacgacgggtaaaccacgtcgtactaaccgggttatactacgtagtacgtaggtcggtacggtccgggaggacggaggaccggaggcctaggacttagttaactgtacaaactcgaaacgtagaacgtagttaaggtacgttagttatacggttgtcgtagggttcccgggngggaacgggacttaaggtcgttacggacccggttcgttaacgggttcaccggtaaccgaacggccgtcccggccccgttcggtaaccgcctttcccgg

SEQ ID NO: 302279 - DNA, 528 bp, Homo sapiens
  misc_feature: GZ8MTXP01AZWCH.52.78.H01.1.454.CMB.2.raw
  modified_base (358)..(358): a, c, t, g, unknown or other
  misc_feature (358)..(358): n is a, c, g, or t
  modified_base (448)..(448): a, c, t, g, unknown or other
  misc_feature (448)..(448): n is a, c, g, or t
  modified_base (472)..(472): a, c, t, g, unknown or other
  misc_feature (472)..(472): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttatggtgatatataaggaccatgagaggccctcagggatccctgagcgattctctcggcctcctcctcgagggaacaacngtcacgttgatcatcagtggagtccgggcaggaggacgaggctagactattactgtacaactcaaactagacagtagtgtactagtgtgngtaggtcggcggaagggacaggcncggaccgtccgaggttcaggccccaaggctaccgccccttcggtccaacgttcccg

SEQ ID NO: 302280 - DNA, 564 bp, Homo sapiens
  misc_feature: GZ8MTXP01DLYK2.52.78.H01.1.454.CMB.2.raw
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggccccttatggtgatatataaggaccatgagaggccctcgagggactcccgtgagcgtatctctcggcctctcctcagggaaccaacngtctaacgttgactcatcgagtggagtccggnaggaggacgaggctagactagttactgtanaatacaacagacagtagttacggtattaagtgtgtcgtaaggttcgggacgggaacgggaaccaaaggtcgttcgaacccgttcgttaacggttccacgaacccgaaggtccgtaccgccccgttcggtccaacgtttccccg

SEQ ID NO: 302281 - DNA, 676 bp, Homo sapiens
  misc_feature: GZ8MTXP01CWDU1.52.78.H01.1.454.CMB.2.raw
  modified_base (304)..(304): a, c, t, g, unknown or other
  misc_feature (304)..(304): n is a, c, g, or t
  modified_base (614)..(614): a, c, t, g, unknown or other
  misc_feature (614)..(614): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggaggtcgttggtccgaggcccggtcggggggtcccctgacacctctccgtgtgtacgtcctcgtgtacttctaacctttaanagtttattggatgtacgttgggtcccgcgaggccgtccggaaggggaaggggcgtgggaggtggggtcggccgaggcgtagaagcagtgagtggggaggtaggaaggaagaaacgttagcggcggtacttcggtaggtaggaacggggcctaagttcccacccttaccttccgaaaggacaaacaaactactaacgaaacgtaactacaaagttacgtaaccttaccgtaacgaaagttcgaacgacctacgcctagaacctacgtacccgggaacgaccgccggtccgttagttaacgttcgaggtcgnggttagttcgtttcggtttaagggctttgggttcggttcgttcgaacccgttaacgtaaccg

SEQ ID NO: 302282 - DNA, 543 bp, Homo sapiens
  misc_feature: GZ8MTXP01A13I9.52.78.H01.1.454.CMB.2.raw
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctggtgtcagtgtcctcaggacagacggccaggatcacctgctctggagatgcactgaccaaagcaatatggttattggtaccagcagagcaggccaggcccctatggngatatataaggaccatgagaggccctgagggactccctgagcgtattctctcggcctcctcccgtcgacgggaaccaacgngtccacgtttgacttcattcaggtggagtcccggnaggaggacgaggctaggtactagttcagtcaaactcgaaacngaacagtagttggactttagcgtgctaggttggcggaaggacgagtcttcgaccgtcttaggttcacgcccgtaggccgccgtccccgacgtcgaacgttcccg

SEQ ID NO: 302283 - DNA, 553 bp, Homo sapiens
  misc_feature: GZ8MTXP01C8680.52.78.H01.1.454.CMB.2.raw
  modified_base (507)..(507): a, c, t, g, unknown or other
  misc_feature (507)..(507): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttattggatgacttcgggtccgcaggctccgagggaggggctggagtgggtgccaggcgtgaagcatgatgggaggtgaggaagaactatggcgggaactcgtggtaggaacggggccaattccaccacttcagagaacaaacataccaaagaactacgaatagtactctaccaaatgagcagctgacacgtccgaggaccacgggccgtgttattacgngtagcgttagttcgtttgttgggattgttggtcgttgccgccgtcg

SEQ ID NO: 302284 - DNA, 652 bp, Homo sapiens
  misc_feature: GZ8MTXP01D9S6O.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtcgtcctcaggacagacggccaggatcacctgctcgtggagatgcactgaccaaagcaaatagttaggttattcgggtaaccagcagaggccacggccacggtcccccttagttggtagaactaatagtaaacggaccagtagagacggtccctacgaggaccttacccgtagagcgtattcctcgtccggtccttcctccgtcgaacgggaaaccaacgtaacgtactaccggttagaacttacaacgttcgtaagggttggggaacggttccccggggacgaaacgggtacgggaaaccggtaaagggtcgttaggtaaccttaagttacgtaacggtaataaacgttacaaaacgtacgtaacgtaggttaagttagttacgtttagtacgtgtcgtaggtcgggaggaacgacgaagcgttagacctcgaggttcacgccaggccacgcccgttagtcttcgtcc

SEQ ID NO: 302285 - DNA, 632 bp, Homo sapiens
  misc_feature: GZ8MTXP01B139U.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttcctccccctcctcactctctgcacaggctcgtggggcctcctatgaactgacacagccaccctcggtgtcagtcgtcctcaggacagacggccaaggactcacctgctcgtggagatgcatgacaaagcaatagttgttagtcgtacagcagacgcacggccacgtccccttagtggtagataataagtaacgacagtgaagacggccctagaggtactccgtgacgcgtacttcctcgtcgcctccctccgtaacgaacggaacaacagtcctacgttagatcatcgagtggacggtccggagaggaggacgagtcgtagtacgtaattacgttacgacgtaaactacgaaacgtacgtaacgtaggttaagtacggtttaacttagtcggtagtacggtacggttaacgggacgggaacgggaaacccaaggtccgtaacggttaccgttcggttaccggtaacgaccggaaccgaacggtcccgttacccgtccccggttaaccggttccccg

SEQ ID NO: 302286 - DNA, 635 bp, Homo sapiens
  misc_feature: GZ8MTXP01DJU3M.52.78.H01.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctggtgtcagtgtcctnaggacagacggcaggatcactgctntggagatgacactgaccaaagcaaatattggttattggtaccagcagaggccaggccacggtcccccttagtcggtagatatagtaagaccatagagacggcctacgagggtactcccgtagacgcgtactttccctcgtaggtcctcccttcccgtaacgaacgggaacctaaacgacgtacctacgttacgactacacgtacaggtagggacggtccgggagaagggaggacggaggtcgtagtaacttaagttatacggtactaaactacgtaaaccagaactaacgttaggtaacgttattaagtgtagtcgtggttcggacgggacgggtaaccttaggacgtcggttaacccgttcgttcgggtaacaccggaacccaacggggtccttacccggtccccgttcggtaacccc

SEQ ID NO: 302287 - DNA, 571 bp, Homo sapiens
  misc_feature: GZ8MTXP01CCK0N.52.78.H01.1.454.CMB.2.raw
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (480)..(480): a, c, t, g, unknown or other
  misc_feature (480)..(480): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctggtgtcagtgtcctcaggacagacggccaggatcacctgctctggagatgcactgaccaaaagcaaatatggttatggtaccagcagagcagcagccccttatgtnatatanaaggacatgagacgccctacgaggactcccgtgagcgtattctcgtccggcctcctcctacgaacgggaaacccaacgtgtactacgtttgactcaatcgaggtacggacggtccggagaaggaggacggaggccgttagaactagtacgtagtacaactacgaaacagtaacaggttagtgtacgttatggtncgtaggtcggcgggaacgagacgcgttcgacccgtcgttacggcacggaacccaggtccctccgaccccgttcggtccttaacgttccccg

SEQ ID NO: 302288 - DNA, 649 bp, Homo sapiens
  misc_feature: GZ8MTXP01CM1I3.52.78.H01.1.454.CMB.2.raw
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggagcgttggtccagccgtggggggtccctgacactctcctgtgtacgcctcgtggtacttctaacctttaacagttattggatgtacgttcgggtcccgcgaggcctaccgaagggggaaggggcgtagggaggtgggggtgcccgagcggtaggaacgcagtgagtgggaggtgaaggaagactagcggcgtactcgtggtacgggaacgggtccgtaacttcccgaacctacgttacccgaagtaacgaacaaactaatacgaaacaacttacaaattgtaactaccgtaaccaaaagtgacgacgaccgctagaaccgagtaccggacggaccgtaccgggccgttattacgtttacnggtaccgnggttaaacgttggttttcgttaagggtattggttcgttacgttcgccgttaaccgtccgg

SEQ ID NO: 302289 - DNA, 742 bp, Homo sapiens
  misc_feature: GZ8MTXP01BGGHR.52.78.H01.1.454.CMB.2.raw
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggntcacctgctctggagatgcactgaccaaagcaaatagttaggttatggtacagcagagcagcacggccctatgnatanataagcatgagcggcctgaggactcccgtagacgtcgtacttcccctcgtcggtccctccctacccgtaacgaacgggaaccaaacgtacggttactaccggtttagaactactaacgttcgaaagggttcggacgggtaccccgggactaaaggggaacgggtaaaccgggaggtaccgtaggtaaacccttaaggtttaaccctggtaaacgtaaacggttaacccaaaacgaacgggtaaactaagggttaaccgttaaggggtttaaaccttttaaggtcggtaggtaacccggtttaaggggtaacccggggtaaaggggaaaccgggggtaacccaaaggtccgggttaacccggttaaacccgggttccgttaaacgggtccgaaccgggtaaccccgaaacgggggtccccttacccgggtccccccgttaacggggttaacccccg

SEQ ID NO: 302290 - DNA, 732 bp, Homo sapiens
  misc_feature: GZ8MTXP01BENV1.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggtcaggatcacctgctctggagatgcactgccaaagcaatatggttatggtaccagcagaggccaggccaggcccccttatcggtgatatataaggaccatgagacggccctcgagggactcccgtgagcgattctctcggcctcctccgtcacgggaaccaacgaacgtcaccgttagacttaccagttccgaaggtcgggtaacggtcccggggaccgtaaggggacgggaacccgggtaaggggtcccttagggtaaaccttaacgtttaacccgtagggttaaccaaacggttaaccaaaaccgaagggtaaacccgtaacggggtttaaacggttaggggtttaaccctttaaacggttgggtttacggaccggttaacgggtttccggggaccggggtaaacgggggtaaccccgttaaagggcccgttaccgggacccggttacccgttacgggggttccaaccgggtaaccccgaaagggtcccgttcccggccccccgttcgggtaacccgttcctttccccgg

SEQ ID NO: 302291 - DNA, 693 bp, Homo sapiens
  misc_feature: GZ8MTXP01AF63G.52.78.H01.1.454.CMB.2.raw
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacacgccacccgtcggtcgtcagtcgtcctcgaggacaggaccggccaaggacttcacctgctcgtaggagatgacacgtacgaccaaagctaactagtgttacgtcggtacagacgaaggacgccgacggccgacggtccccttagtcggtagtactagtagtaaacggacctagtaccggacggacgtcccgtagacgggtaactacccggtgacgtcgtattccgtcgttcgggccttcccgtaccgttcgaacgggaactaacgtacggtacgtaacgttcgaacttccgaattacgaggttacggacgggtaccgggggacgtaaggacggtaaccggaagtccgtaagtacgtttaacgttacgtacgttacgaaacttacggaacgtaaggaccgtaggttaaggttccggtaacgttagcggttcgtaacggtacggttaaccggggcgggtaacggaccgtaacgccggttaacccggg

SEQ ID NO: 302292 - DNA, 762 bp, Homo sapiens
  misc_feature: GZ8MTXP01D4IFH.52.78.H01.1.454.CMB.2.raw
  modified_base (227)..(227): a, c, t, g, unknown or other
  misc_feature (227)..(227): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagntgcactgaccaaagctaaatattaggttattggtaaccagacaggagccgaggtcacgggtccccttagttggtgaataagtaataacggacctagtaggagacggtcccctagacgggtactccctgacgcgtacttccgtcgtcggcccttcctccgtaaacgaacgggaactaaacgtagttaccgacgtttacgaactctaacgttaccgtaggtacgggtacgggtacccgggagtaaaggggtaaccgggagggtacgggtacctaaggaaactttaacgttaacgttacgttaaccggtaaaacttacgaaaaaccgacggtaaacgttacggttaaacgggttaggttttaaaccgtttaaggttcggttaaggtacggtaacggggtttaacccggggtaacgggaaacggggttaacccgaaaggtaccgttaccggggttaaacccgttcgttaaacggggttccaaccgggttaacccgaacgggtcccgttaccccggttccccggttcgggtttaaccccg

SEQ ID NO: 302293 - DNA, 655 bp, Homo sapiens
  misc_feature: GZ8MTXP01ATPO2.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagcttgggttttccttgttgcttattttagaaggtgtccagtgtgaggcgcagcgtggtggagtcgtgggggaggtcttggtccgaggccggtcgggggtccctgacactctcctgtgtacgcctcgtggtacttctaacctttaacagtttattggatgacgtttcgggtcccgccaggcctccggaagggggaaggggtctaggggaggtgggggtcggccaggcgtagaacgcagtggagtgggaggtaggaaggaagtaactagtggcggtactgtggtaggaacgggctattaccacctacttaccaagacgaacaaacactaacaaacgaactacgaaattcgtaactccggtaaacaaaagtcggaacaccgacgtcctaggaacctacgtacccgggaagtacccgccgggtcgttagttacttaggttcgtaggacgttaaggttcgtttcgggtttgggtatttggttcgttcggttcaaccgttaaccgtccgg

SEQ ID NO: 302294 - DNA, 630 bp, Homo sapiens
  misc_feature: GZ8MTXP01A2MKF.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctgggtggagtcgtgggggaggcgttggtccgagccgtggggggtccctgacactctcctgtgtacgcctcgtggtacttctacctttaacagttagttggatgtacgttcgggtcccgcgtaggcctaccggaagggggaacggggtcgtgggtaggtggggtcggcccaggtcgtagaagcagtggagtggggaggtaggaaggaacgtaacgtagtcggcggtaacttcgtgggtaggaacgggcctacttaccgaaccctacttacgagaacgacaaacactaacaagtaaccttagaattacgtattaccaacgtaaagtgaacgcacgcctagactacgccggtacgaccgcgtcgtattcgtacgttgtcgaggttagttcggttcggttaaggtgttcgttgtcgttcgcgaacgtccg

SEQ ID NO: 302295 - DNA, 631 bp, Homo sapiens
  misc_feature: GZ8MTXP01AMZQU.52.78.H01.1.454.CMB.2.raw
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccaggcccccttatggtgatatataaaggaccatgagacggccctacgaggggactccctgacgcgattctctcggcctcctcctcgagggaacaacngtcaccggtttanactcatacgaggtggacggtaccgggagagggacgggacggacggcgtacgtacttacttacgtagtacaagtacgaacgagtaacgtaggttaaggtacgttaacttagtagtcggtacggttacgggttaccgggacggggtaacggtaaccgacggtaccgttaccggtacccggttacgttacgggttccgaccggaaccccggtacggtccccgtccccggtccccgttaccggtcccttcccgttcccg

SEQ ID NO: 302296 - DNA, 564 bp, Homo sapiens
  misc_feature: GZ8MTXP01CLCZ3.52.78.H01.1.454.CMB.2.raw
  modified_base (283)..(283): a, c, t, g, unknown or other
  misc_feature (283)..(283): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacttaanagttatggatgacttggtccgcaggctccgagggaaggggctggagtgggtggccagcgtgaagcatgaatggaggtgaggaagaactatgcgatcgtgtgaagggcattcacactcagacacaacatacaaagaactacaatgtaacttactaacctaaaatcgacgacacggccctaggaaacctacgtcccggaaggtaccgaaccgggtccttagttacttacgttgtagcgttagttgtttcgttggggattggttcgtcgttcgccgcgtaacgg

SEQ ID NO: 302297 - DNA, 686 bp, Homo sapiens
  misc_feature: GZ8MTXP01CHM4Y.52.78.H01.1.454.CMB.2.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (675)..(675): a, c, t, g, unknown or other
  misc_feature (675)..(675): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagnggccaggccacggccccttatggtnatatataaggaccatgagacggcctcgaggactccctagagtcgtattcctcgtccggcctcctcctcgacggggtaaccaacgtgtacctacggtttgaactcgactaccgagggttacgggaacgggttcccggggacgacggggaacggggtaaccgggaacgggtccgttaacgggtaacctttaacgttaaccgttcggttaacctaacgttaaccaaacgtaacggtaaccgtaacggttaaggttacggttaccgtttaagtccggttagccgttaggttcggggacgggtaacggggaacccagggtcgttaccggaaccgttcggttacggttccacgtcccggaacggtccgtacccggtcccccgttacgggttcccncgtttccccgg

SEQ ID NO: 302298 - DNA, 858 bp, Homo sapiens
  misc_feature: GZ8MTXP01CKTTG.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctcgtggagatgacactcgaccaaagctaattagttaggttaagttcggtaaccagacgaaggacggaccgaacggcccgtaaccggtacccccctttagttcggtaagtaataaagttaaacgtaaacggtaaccgtagtacggaacggtaccggtccccgtacggaacgggggtacctacccgttaggacgtacggtaacttccccgttcgtcggtcctccccgttaccgaaccgaagggtaacctaaacgtacgtaaccgttacgttagacgttacacttacggtaggtaagggtacccgggtaccggggaccgtaaagggggtaccggggtaacgggaacgggtacccgttaaagggtaaaccttttaaaccgttaagtttacggttaaaccgtaaacgttaacccctaaaaggaacggtaaaccgttaaggttaaacccggttaggttttaaaaccttaacggttgggttaccgtagggttacggggttaacccggggaaccgggttaaacgggttaaacccgaacggttacccggtaccggttaacccgggttcgttaccgggggttaacccctaacggaaccccggaaccgggttcccttacccccgggttaacccccgtttcgggttaaccccg

SEQ ID NO: 302299 - DNA, 771 bp, Homo sapiens
  misc_feature: GZ8MTXP01EDT1G.52.78.H01.1.454.CMB.2.raw
  modified_base (228)..(228): a, c, t, g, unknown or other
  misc_feature (228)..(228): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacacgccaccctcggtgtcagtcgtcctcaggacagacggccaggatccacctgctcgtgganatgcactgaccaaagctaaatagttaggttattacggtaccagcaggacggaccgacggccgacggtcccccgttagttcgggtataataaagttaagaaacggacctaagtaggaacggtacggaccccgtacggaagggtaacctccgtagacgcgtacttcctcgtcgtcctccctcctaacgacgggaacaaacgacgtactacgttgactacgtactcgtaggtacggacgtacccgggagagggaaagggacggaacgggtcttaacggtaaccgtttaattacgttaacggttaacgtaaacttaaaccgaaacgtaacgtaaaccggtaagtttaagggtttaccggttaaaacgtttagttgggttacgtaccggttaagggtttaacccggggccggggaaagggtaaacccgttaacgtacccggttaacgggttaccccggttaccggttacgggtaacccgtaaaccggaacccccggtaaaggttcccccgttacccgggtcccccccgttttaacggggtaacccccg

SEQ ID NO: 302300 - DNA, 713 bp, Homo sapiens
  misc_feature: GZ8MTXP01D17AQ.52.78.H01.1.454.CMB.2.raw
  modified_base (295)..(295): a, c, t, g, unknown or other
  misc_feature (295)..(295): n is a, c, g, or t
  modified_base (438)..(438): a, c, t, g, unknown or other
  misc_feature (438)..(438): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtcgtcctcaggacagacggccaggatcacctgctcgtggagatgcactgaccaaagcaatatggttattggtacagcagaggcacggccacggtcccccttagttcggngagtaataagtaagaccatagaagacggcctcgaaggactcccgtgacgcgtattccctcgtcgctccctcctaacgacgggaacaaacgtacgtctaacgttgacttacacgtacgtaggtacgggtacgggtacccggganaaacgggaaacgggacgggaacggtccgttaggtaacccgttaattacgtacgtaacgtaaacttacgaaaaccgagaaaccgtaaggtttaacggttaaggttaaaccgtttagtgggttacggtacccgtaagggtttccggggaacgggaacggggttaaaccaaacgggtccgttaacccgggaaccccggtttcggttaaaccggggttcaaaccggtaaccccggaaacggtcccgttaccccgtcccccggtttcgggttaacccccg

SEQ ID NO: 302301 - DNA, 571 bp, Homo sapiens
  misc_feature: GZ8MTXP01CRABO.52.78.H01.1.454.CMB.2.raw
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
  modified_base (520)..(520): a, c, t, g, unknown or other
  misc_feature (520)..(520): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtggggggagcgttgggtccaggccgtggggggtccctgacactctcctgtgtacgcctctggtattctacctttaacagtttatggatgacgttgggccgcaggctccgaggggaggggctgggagtggggtgccgagcgtgagcatgatgggaggtgaaggagaactatggcgactgtgaggaacgggccattccacctacttccagacacaaanatanaaacgactnaatgtaactcctacaaagtnaacgcacgtccctagaacaccgtaccgaacggaccgcggtccctggttacttacgnggtagtcgagttcggtttcgttgggtattggttcggtgttcgccaacgtcg

SEQ ID NO: 302302 - DNA, 725 bp, Homo sapiens
  misc_feature: GZ8MTXP01BPIOL.52.78.H01.1.454.CMB.2.raw
  modified_base (280)..(280): a, c, t, g, unknown or other
  misc_feature (280)..(280): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagagcaggcacgcccctatggtnatatataagaccatgagacgccctacgagggactcccgtagacgcgtacttcgtctcggcctccgtcctcgacgggaaaccaacgtaacgtctacgttgactctatacgtaggtacgggacggttacccggggagaacgggacgggaacggaacgggtctacggttaaacttagtttaacccgtggttaaaccgtaaactaaccgtaaaacgtaacggtaaccgtaaacgggttaagttccgggtttaactttaagttggtacgtacggttaaacgggtttccggggaacggggaaaccggggtaaaccgaacgggtacccggttacgggtaaacccccggttaccgttaacggggttacccgaaccgggaaccccggtaaacgggtccccgttccccggggtcccccccgttaccggggtttcccaacccggtttttcccccgg

SEQ ID NO: 302303 - DNA, 662 bp, Homo sapiens
  misc_feature: GZ8MTXP01C1R5H.52.78.H01.1.454.CMB.2.raw
  modified_base (272)..(272): a, c, t, g, unknown or other
  misc_feature (272)..(272): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttcctccccctcctcactctctgcacaggctctggggcctcctatgaactgacacacgccaccctcggtgtcagtcgtcctcaggacaggaccggccaggactccacctgctcgtgganatgcatgacaaagcaatatggttataggtacagacaggacggccaacggccctacggtcccccttagttcgggtagataataacgtaaaggaccaagtacggacggtacggccctacggaacggtaactcccgtgacggtacgtaacttccgtacgtcgggtccctccgtacctcgaaggaccaactagtcgaacgtttcgacttacatccgaggtacggtacggtccgggggacgaacgggacggaacggacggccgtaaggtacttaacgttactacgttacaaactaacaaacaacgaacgtaaggttacgttagggtaactttaggttggttacgtaaggtacggttaacgggacgggtaacgggacctaacggttcgtaacccgg

SEQ ID NO: 302304 - DNA, 583 bp, Homo sapiens
  misc_feature: GZ8MTXP01C1EF3.52.78.H01.1.454.CMB.2.raw
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagcttgggttttccttgttgcttatttagaaggtgtccagtgtgaggcgcagctggtggagtcgtgggggagcttggtccagccgtgggggtccctgacactctctgtgtacgcctctggattcaacctttaacngttatggatgacttgggtccncaggctccgagggaggggctggagtgggtgccagcgtgaagcatgatggagtgaggagactangcgatctgtgaagggcattcaccacttcagagacaaacatacaaagaactacaatgtaactcgtaaccaaatgacgtacaacgcctagaacacgtaccggaacggaccaccggggtccttagttaacttaccgttggtacggccgttaaaggttggttttaccggtttaaggggattggttttcggtcggtttcgaaccgttaaccgtaaccgg

SEQ ID NO: 302305 - DNA, 600 bp, Homo sapiens
  misc_feature: GZ8MTXP01COW84.52.78.H01.1.454.CMB.2.raw
  modified_base (507)..(507): a, c, t, g, unknown or other
  misc_feature (507)..(507): n is a, c, g, or t
  modified_base (551)..(551): a, c, t, g, unknown or other
  misc_feature (551)..(551): n is a, c, g, or t
  modified_base (593)..(593): a, c, t, g, unknown or other
  misc_feature (593)..(593): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtggggggagtcttggtccagccgtggggggtccctgacactctcctgtgtagcctcgtggtacttctacctttaacagttatggatgtacgttcggccgcgaggctcggagggaggggcgtggaggtggggtcgaccgaggcgtagagcagtgagtgggaggtgaggaacgaatagcggacgtactcgtaggtagggaacgggtccgtacttcccgaacctaccttaccgagaacgaacaaacgtataacaaacgaactactaatcgtaactactaacaaagtgaacgtcncgcgtagactacgacccgaggaccgcggtcgtattacgttacgnggtacgtgttacgttgtttagttgggattggttcgtagttcncgcgtcg

SEQ ID NO: 302306 - DNA, 546 bp, Homo sapiens
  misc_feature: GZ8MTXP01DFLQ5.52.78.H01.1.454.CMB.2.raw
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (425)..(425): a, c, t, g, unknown or other
  misc_feature (425)..(425): n is a, c, g, or t
  modified_base (516)..(516): a, c, t, g, unknown or other
  misc_feature (516)..(516): n is a, c, g, or t
tcagcgcagtacgacacgaccggtgctcgatttagtgtgagtagttgggtttggggaggtctcggagaggagccttagccctggactccaaggcctttccacttggtgatcagcactgaacacagaggactcaccatggagttggggctgagctgggttttccttgttgctattttagaaggtgtccagtgtgaggcgcagctggtggagtcgtgggggagcttggtccagccgtggggggtcccctgacactctcctgtgtagcctctggattcacttaacagtatgatgacttggccncgagctcgagggaggctggagtggtgccagcgtgagcagtgagtggaggtagaggaanactaagtgcggactcgtgtagagggctatcactactccaagagtacaaacataccaaagtacctaanaatgtacactaacgaaatgacgcgagcctagacacgcggagacgccggtgtaatacttgtggcgtacggtgttacggtttcggttagggtntttggttcggtcgtcgaccgtccgcgtccg

SEQ ID NO: 302307 - DNA, 689 bp, Homo sapiens
  misc_feature: GZ8MTXP01CPMSS.52.78.H01.1.454.CMB.2.raw
  modified_base (542)..(542): a, c, t, g, unknown or other
  misc_feature (542)..(542): n is a, c, g, or t
  modified_base (678)..(678): a, c, t, g, unknown or other
  misc_feature (678)..(678): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtaaggcgcagctggtggagtcgtggggggagtcttgggtccaggccggtcggggggtccctgacctactcctccgtgtgtacgcccttcgtggtacttcctaacctttaacagttagttggtatcggtacgtttcggggtccccgccgaggtcctaccggagggggaacgggcgtggggaggtgggggtacggcccgtagggtccggtaggaaacggctaagtggtacggtcggggaagggtaggaaggaaacgtacgttaagcgggcgtacttcggtaggtagggaacgggcctattcccaacccttacgtaccgaaggaacaccaactaataccaaagtaacctanaattactactaccaaacgtaagtcggaacaccgtcgtacctacgaccgtaccggaccggaacggaccgtcggtcttaagttacttggtcgacgtacgtagttcggtttggttcggtaattcggttgtccgtgaccncgttcgtcccg

SEQ ID NO: 302308 - DNA, 622 bp, Homo sapiens
  misc_feature: GZ8MTXP01D5XQ4.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacaggacggccaggatcacctgctcgtggagatgcactgaccaaagcaaatagtaggttattggtaccagcagacgcacggccacggtccccttagtggtgataagtacgtaaggaccagtagaacgacggcctacgaggactccgttagagcgtattcctcgtgcctccctcctaacgagggaacaaacgtacgtactacgttgaactcatacgaagtcgggacggtcgggacaaggaggacgaggctagtacttacttacgtatactaaacgttacaaagtacgaagtaggtagttaggttaacttagtaggttgacgtaggttcgggacgggaggtaaccgttaacggtactcggttaaccgttccgttacggtccgaaccggtccgaacgggtcccttcccggtccccgttcggttaacccc

SEQ ID NO: 302309 - DNA, 655 bp, Homo sapiens
  misc_feature: GZ8MTXP01BB24T.52.78.H01.1.454.CMB.2.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattgtacagcagaggccaggccacggtcccctagttggtnatataataagacatagagagcctcgagggctccctgagcgattctcgtcggcctcctcgtcgagggtaaacaacgtgtctaccgtgatacatcgtaggtcggtacgtaccgggacgagggaggacggaacgggtcgtaggtaacttaattacgttacggttacaaacgttacggaaacgtaaaggaaccgtaagggttaaggttaacgggttatttaagttggttaaggtacccgttaggttcccggggacgggggaaacgggaaccggttaaacggccgttacgggtaacccggtaccgttacggcgacccggaacccgtaacgggccttacccgggccccgttacggtccttaacccgtttcccgg

SEQ ID NO: 302310 - DNA, 589 bp, Homo sapiens
  misc_feature: GZ8MTXP01D3Z2X.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatataggttattggtacagcagaggccaggccacggtcccctagttcggagatatagtaaaggaccatgagacgcctcgagggactcccgagagcgtatctcgtcgtcctctctcgacggaacaacgtgtctacgttgatacactagaggtaggacggtccgggacaggacggacggtaggtctaggtacttacgttacgtagtaactaacgtacaaacgtacgaacgtagtagtcggtattagtgcgtgtaggtcgggcggtaaggacgaaagcgttacgaccgttcgttacggcttaccggaaccgaacggtccgtacccgccccgttcggtccttaacgtttccccg

SEQ ID NO: 302311 - DNA, 836 bp, Homo sapiens
  misc_feature: GZ8MTXP01AYEX2.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttcctcccctcctcactctctgcacaggctctggggcctcctatgaactgacacagcccaccctcggtgtcagtgtcctcaggacagacgccaggatcacctgctcgtggagatgaccactcgaccaaagactaatagttaggtttaattcggtaaccaggacgaacggacggacccgaggcccgtaccggtcccccttagttggtagtaataagttaagtaaacggaccaagtcgaaggtaccggaccctacggacggggtacctcccgtaggacgtacgtcttcctcgttccccggtcctaccgtcccgtacgaacgggaaaaccaacgtcgtacgtaacgtttacgctaacgtacgtacgtagggtacgggttaccggggtaccgggacggtaggggaaccggggtacggaacgggttaccggttaaggtaaacccttaagtttacggtaacgtaacttaaaacggtaaccgaaacgaaaccggggtaaacgttaaagggtttaaccgtttacgggggtttaaactttacggttttgggacggttaacccggggtaagggtttacccgggggaacgggggtaaccgggaaaccggttaaacgtcccgggttaccgggttacccgggtacggtttaacccgggcccttacccggggtaaccccggaacgggtcccctttaccgggccccccgttacggtttaaacccggcccttttcccccgg

SEQ ID NO: 302312 - DNA, 642 bp, Homo sapiens
  misc_feature: GZ8MTXP01EJS0Y.52.78.H01.1.454.CMB.2.raw
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (494)..(494): a, c, t, g, unknown or other
  misc_feature (494)..(494): n is a, c, g, or t
  modified_base (535)..(535): a, c, t, g, unknown or other
  misc_feature (535)..(535): n is a, c, g, or t
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
  modified_base (618)..(618): a, c, t, g, unknown or other
  misc_feature (618)..(618): n is a, c, g, or t
  modified_base (631)..(631): a, c, t, g, unknown or other
  misc_feature (631)..(631): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggaggtcttggtccagccgtcgggggtcccctgacactctcctgtgtacgcctntgattcaacttaacagttatggatgtacgttgggtcccnccgaggcctaccggagggggtaacggggcgtagggaggtgggggtacggcccaggcgtagaagtcagtggagtaggggaggtggaaacggaagaacgtagtcgggacgtacgtcgtggtaagggaacggggtcctaacttccgaacctactaccgaagaacaacaaactactaacgaaanaacctataaattattaactacgtaaccaaaagttcggaacncgaaacgccttaaggacctaacgtccggaagtaccgccggtcggttattacgttcnggtgngttaagttgtttcggtaaggtntggttcgtgttcncgttaacgtcg

SEQ ID NO: 302313 - DNA, 695 bp, Homo sapiens
  misc_feature: GZ8MTXP01AFAYF.52.78.H01.1.454.CMB.2.raw
  modified_base (373)..(373): a, c, t, g, unknown or other
  misc_feature (373)..(373): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctgggtggagtcgtgggggagcttggtccagccgtggggggtccctgactactctcctgtgtacgcctctggtattctacctttaacagttattggatggacgttgggtcccgccgaggcctccgaggggaggggtctgggagtggggtcggccaggcgtagaagctagngagtggggaggtaggaggaagtaacgttagtcgggacggtaacttcgtgggtagggaacggggtcccgtaatttccccgaacctacgttacccgaagacgaaacaaactacgaagaaacgaaactacctaaaagtcttaaacttacccgtaacctaaaagtcggaaccggtaccaacggccttaacggaacctacgtaccgggacggtaaaccgccgggtccgttaggtttaaactcgttagggtaccgtagggaggtttaccgtttcgggtttgggtattttcgggtttcggtccgtttacggaacccttaaccggtcccg

SEQ ID NO: 302314 - DNA, 753 bp, Homo sapiens
  misc_feature: GZ8MTXP01AP0Z3.52.78.H01.1.454.CMB.2.raw
  modified_base (225)..(225): a, c, t, g, unknown or other
  misc_feature (225)..(225): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcactgctctgganatgcactgaccaaagcaatatggttatgtacagcagacgcaggccacggccccttagtggtgatatagtaacggacagtgagacgccctagaggactccgtagacgcgtactttcctcgtggtccctcccgtccctacgaacgggaacctaaacgtacgttaccgtaccgtttagacttaccgaaagtccgtaagggttacgggaacgggtacccgggggacgaaacgggaacggggaaccgggtacgggtaccgttaagggtaaaccctttaaagtttaccgttacggtaaccgtaaaacttaaccgaaaccgaaagggtaaaccgtacgggttaaggttacgggtttaaccttaaggtcggttaggtacggtacggggtttaaccggggacggggttaaaggggaaccccgttaaagggtcccgttaaccgggaaccccggttccgttaaacggggtccgtaacccggaacccccggtaaacgggtccccgttacccggtccccccgggtttccgggttaaccccg

SEQ ID NO: 302315 - DNA, 652 bp, Homo sapiens
  misc_feature: GZ8MTXP01C695F.52.78.H01.1.454.CMB.2.raw
  modified_base (577)..(577): a, c, t, g, unknown or other
  misc_feature (577)..(577): n is a, c, g, or t
tcagcgcagtacgacacgaccggtgctcgatttagtgtgagtagtttgggtttgggggtgggtccaggaggtagaactctgggtgtctcaccatggcctggatccctctacttctccccctcctcactctctgcacaggctctggggccctcctatgaactgacacagccaccctggtgtcagtgtcctcaggacagacggccaggatcacctgctcgtggagatgcactagaccaaagcaattagtggttatcggtaccagcagaggaccacggccacggtccccttagtcggtagatatataagacagtgagacggccctagacggactcccgtgagtcgtattcgtcgtcgtccctcctccgtagacggaaccaaacgtacgtcgtacggttacacgtactagtacgtaagggtcgggtaacggtcccgggagaagggacgggaacggtacgacgttcgtaacgttaacgtttagacgtaaactaacgttaacaaacgtaaacggtagtaaaggtttaggttagtttaaccgttagttgtaccggtggtacgggttcgggacgggacggtaacncggacgtccgggttaccgtacgtacggcgttacgccgaacgtcgcccgtacccgtcgttcctcttccgttaaccc

SEQ ID NO: 302316 - DNA, 661 bp, Homo sapiens
  misc_feature: GZ8MTXP01AWQXH.52.78.H01.1.454.CMB.2.raw
  modified_base (186)..(186): a, c, t, g, unknown or other
  misc_feature (186)..(186): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (604)..(604): a, c, t, g, unknown or other
  misc_feature (604)..(604): n is a, c, g, or t
  modified_base (637)..(637): a, c, t, g, unknown or other
  misc_feature (637)..(637): n is a, c, g, or t
  modified_base (646)..(646): a, c, t, g, unknown or other
  misc_feature (646)..(646): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtntccagtgtgaggcgcagcgtggtggagtcgtgggggagtcgttggtccgagccgtcgggggtccctgacnctctctgtgtagcctntggattctaacctttaacagttgtggtatgtacgttcgggtccgccgacggcctccggaaggggaacggggcgtgggacggtggggtcggccgaggcgtagaaagcgagtggtaacgtgggagggtaggaaggaagtaaactagtcggacggtaactcggtaggtagggaacgggccgtaacttccaacccgtacttaccgaagaacaaccaaacntaacgaaanaaccttagtaaattctaaactctaaaccgaaagtacgacgcccaggtacccaggaaaccctggtaccccgaggaacccgtcggtccgtagttataccgttgtaccgngttaaggttccgtttgttggggatttggtttanccggttacncgttaacccgtccgg

SEQ ID NO: 302317 - DNA, 637 bp, Homo sapiens
  misc_feature: GZ8MTXP01BVENE.52.78.H01.1.454.CMB.2.raw
  modified_base (474)..(474): a, c, t, g, unknown or other
  misc_feature (474)..(474): n is a, c, g, or t
  modified_base (522)..(522): a, c, t, g, unknown or other
  misc_feature (522)..(522): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctatttagaaggtgtccagtgtgaggcgcagctggtggagtcgtgggggagcttggtccagccgtggggggtccctgacactctcctgtgtagcctctggattcacctttaacagttatggatgacgttgggtcccgccaggctccgaggggaaggggctgggaggtggggtggcccaggcgtagaagcatgagtggaggtgaaggagaactatcggacgtactcgtggtagggtaacgggccgtattaccacctaccttaccaggaacaacaaacaactaacaaacgtaaacctactaaatnttaaactcgtaaccctaaaagtcgaacgcaacggtccctaggaaaccncgtaccggaaggtaacccggcgggtcccgtaggttaacttaccgttggttcgacgggttaagttcggtttacggttggggtactttggtttagtcggtttcgaaccgaacctcgg

SEQ ID NO: 302318 - DNA, 703 bp, Homo sapiens
  misc_feature: GZ8MTXP01ASSI7.52.78.H01.1.454.CMB.2.raw
  modified_base (224)..(224): a, c, t, g, unknown or other
  misc_feature (224)..(224): n is a, c, g, or t
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
  modified_base (505)..(505): a, c, t, g, unknown or other
  misc_feature (505)..(505): n is a, c, g, or t
tcagcgcagtacgacacgaccggtgctcgatttagtgtgagtagtttgggtttgggggtgggtccaggaggcagaactctgggtgtctcaccatggcctggatccctctacttcctcccctcctcactctctgcacaggctctggggcctcctatgaactgacacagccaccctcggtgtcagtcgtcctcaggacagaccggccaggatcacctgctctgganatgcactgaccaaagctaaattagtggttattggaccagacaggacggccaggacctacggtccccttagttcggtagattaagtaagtaaacggcctaagcggaagccggaccccgtaggagggtaccttcccgaggacgtacgtctttccncgttcggacccttcctacccgtagaacggaaaaccaactcgacccaaggtttanactacatcgagtccgggacgtccggagaggaaggacggaggactaggtaacttaacgttactgtaaccttaaanacggaaacgtaacgtaaacgtaaggttaaggttacgttaaacgttaggttacggtacggtaccggttaaccgggtacggggaacgggtaaccgggaaccgttacggtcgttaccgggttaccgtaacggttacggttaccgaccggaaccggtaccggtcccgttaccccggtcccgttacgtcccgttcggtccccg

SEQ ID NO: 302319 - DNA, 569 bp, Homo sapiens
  misc_feature: GZ8MTXP01CCS27.52.78.H01.1.454.CMB.2.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (418)..(418): a, c, t, g, unknown or other
  misc_feature (418)..(418): n is a, c, g, or t
  modified_base (511)..(511): a, c, t, g, unknown or other
  misc_feature (511)..(511): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagctgggtttctgtgctatttagaggtgtccagtgtgaggcgcagctggtggagtcgtgggggagcttggtccagccgtgggggtccctgacactctcctgtgtagcctntggtattcacctttaanagttatgatgacgttggtccncgaggcctcgaggggaaggcgtggaggtgggtgcccgaggcgtagaagtcagtgacgtggaggtgagganaactagngcgactgtgagagggcattccgactacgtcagacgaacaacgntaacgaaagacctagaaattgtaacctactaacgaaagtgactgaccgccgtagacgacgtaccggaagaccgtacgggtcttgttaactcgngtacgtcgttaagtttcgtttggttgggatttgtacgttcggttacaaccgcgtaacg

SEQ ID NO: 302320 - DNA, 682 bp, Homo sapiens
  misc_feature: GZ8MTXP01CBXJQ.52.78.H01.1.454.CMB.2.raw
  modified_base (247)..(247): a, c, t, g, unknown or other
  misc_feature (247)..(247): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctcgtggggcctcctatgaactgacacacgcccaccctcggtgtcagtcgtcctcaggacagacggccaggactcactgctcgtgganatcgacacgtcgaccaaagactaatagttaggttattcggtaaccagcgaaggacggccgacggccgaccggtcccctttagtcggtataatagtaagtaaggaccagtagacgacggtccctaccggaggtactcccgtgacgtacgtacttctcgtcggtcctccctaccgacggtacggaactacgtagttaccctaggttacactacgtacgtacggagggttacgggacggttcccgggaagagggaaccggacggggacggtacgttacggtaaactttacgtacgttacggtactaaactaccgaaaacgtacggtacgttagggttaacgttagggttaccttaggttggtaccggtgttaaacgggttcgggacgggtaacggacccgtaagtccgtacggttacccggttaacgaacggtaaccg

SEQ ID NO: 302321 - DNA, 554 bp, Homo sapiens
  misc_feature: GZ8MTXP01EH6VQ.52.78.H01.1.454.CMB.2.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (434)..(434): a, c, t, g, unknown or other
  misc_feature (434)..(434): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcatgaccaaagcaatatgtatggtacagcagagcagccagccccttatgtgatatanaagacatgagacgccncgaagggactcccagacgacgtacttcctctcggctccctcctaccgaacgggaacaacaggtcaacgttgaactcaatcgtaagtcggaggccggagaggaggagagctggaattatacgtagtacgaaaanaacaacaagacgtaagtagtagttagttagtgtagtacgtaggtaacgggacgggacggacgacgtacgtacgttacgttcgttacgaacgacgaaccgacgtcgccgtccgttcgtccg

SEQ ID NO: 302322 - DNA, 758 bp, Homo sapiens
  misc_feature: GZ8MTXP01CHAO7.52.78.H01.1.454.CMB.2.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattgtacagnagaggcaggccacggccccttagtcggtgatatanaaggaccagtgagacgccctacgagggactcccgtgacgcgtattcgtactccggtcctcctccgtacgacggggtaaaccaaccgnggtaccacgtagtttagacttacacgtacccgtagggttacgggacgggttacccgggggacgacggggtaacggggaacccgggtagggtacccgttgggtaaacttaacggtttaccctagggttaaccctaaacggggttaccaaaaccgtaacggtaaaccgtaagggttaacggttacggggtttaacccgtttaaaggttacggttcgggtaccggtaacggggttttccgggggaaccgggttaacgggggaaacccggtaaccgttacgggttaccggtaaccccggttacccggtttgggacccgtaaccgggacccggtaaaccgggtcccgtcccggttaccccccgttcggttccccgttaaccccgg

SEQ ID NO: 302323 - DNA, 651 bp, Homo sapiens
  misc_feature: GZ8MTXP01AYQZJ.52.78.H01.1.454.CMB.2.raw
  modified_base (180)..(180): a, c, t, g, unknown or other
  misc_feature (180)..(180): n is a, c, g, or t
tcagcgcagtacgacacgaccggtgctcgatttagtgtgagtagtttgggtttgggggtgggtccaggaggcagaactctgggtgtctcaccatgggcctggatccctctacttctccccctcctcactctctgcacaggctctggggcctcctatgaactgacacagccaccctcggtntccagtgtcctcaggacaggacggccaggactccacctgctcgtggagatgcactgaccaaagcaattatggttatggtacagcaggacggccgacggccgacggtcccccttagtggtagtataatagtaaaggacctagtggagacggccctacggacgggtactcccgtagacgacgtacttcgtcgtccggtcctccgtccgtacggaacggggaaacctaacgtcgtaccgtacgttacgtactctaacgtcgtaagggtcggtacggtccgggacgagggacggacgaggctagtacttagttacgtacgtacaatacgaacagtacgaagtagtagtacttagtgtagtcgtaggttacggggcggaacgggacccgaggtaccgttacggtaaccggtcgttacggccgaccggtaacccgaacgtcccgtacccggccccgttacggtcccttcgttccccg

SEQ ID NO: 302324 - DNA, 743 bp, Homo sapiens
  misc_feature: GZ8MTXP01DRXPJ.52.78.H01.1.454.CMB.2.raw
  modified_base (452)..(452): a, c, t, g, unknown or other
  misc_feature (452)..(452): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctcgtgggcctcctatgaactgacacagccaccctggtgtcagtcgtcctcaggacagacgccagactcactgctctggagatgcactgaccaaagcaatatggttatgtacagcagacgcgacgccaccgtccccttagtcggtagatatagtaaacgacctagtcgacggacgcccgtacgaacgggtaactcccgtgacgtacgtattcctcgtcggtcctcccgtaccgtacgaacgggaaccaaacgtacgtacgtaaaccggttntaaactacgtaacgtaccgtaagggtttacggggtaaccgggtaccccggggggtaaggtaacggggtaaacgggaaccgggtaaacggtcccgttaacggtaaacctttaaaccgtttaccgttaaccggtaaccgtaaaaccttaaccgaaaacccgtaaacggttaaacggttaaacggtttaaggttaaccggggttttaaacttaacgggttggttaccggtaacggttacggggtttccgggaacggggtaacgggaacccgtaacggttcgttaacccccgggg

SEQ ID NO: 302325 - DNA, 757 bp, Homo sapiens
  misc_feature: GZ8MTXP01DV9IB.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctaccttctccccctcctcactctctgcacaggctcgtgggcctcctatgaactgacacacgcccacccgtcggtgtcagtcgtcctcgaggacagacgccaggactcacctgctcgtggagtatcgacacgtacgaaccaaagactaaatagttaggtttaacgttaggtaacccaggacgaaggacggacccgaccggcccgtaccggtaccccctttaggttacggttagaagtttaagtaacgttaaacgaccgtaagtacggaacggaccggtccctacggacgggtactccccgtaggacgtaacgttctttcgtccgtcggtcccttcccgtaccgacgacgggaaccaaccgtgttaccgacggttcgaacttacgagtaccgtagggtcggacggtaccggggagaaggacggacggggaccgttaggtactaacgtttacgtactacggtaactaaaaccactaaaccggaacgtacgagggtttaaacgtttcggttaaacgttttagggttcggttacgtaccgggttacgggggttccgggaaccggggtaaacggtaaaccgtaacggttacccggttacccgggttacccggttaaccggttaaccgggtaaccg

SEQ ID NO: 302326 - DNA, 686 bp, Homo sapiens
  misc_feature: GZ8MTXP01AJX3F.52.78.H01.1.454.CMB.2.raw
  modified_base (245)..(245): a, c, t, g, unknown or other
  misc_feature (245)..(245): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctcgtggggcctcctatgaactgacacacgccaccctcggtgtcagtgtcctcgaggacagacggccaggatccactgctcgtgganatcgacacgtcgaccaaagctaaatacgttaggttattacggtaaccaggacgaggacggacccaacggccgtaccggtccccctttaagtttcggtagtaagttaattaacgtaaagggacctagttaggaacgaccggcccctacggaacggggtactaccccgtagaggacccgttatttccgtcgtcgggtccttccccgtcctacggacgggtaaccaacgtacgtacctacggttanactanacgtacgaggtacggtacggcccggagaggacgggacggtaggcgttacgtaacgttattaccgtgtaacgtaaactacaaaacgtcgtaacgtaaggttaaggttagttacttaagttggtacgtgttacgggttccgggacggggtaacggacgtaaacgtccgtcggacccgttcgttaacggaacccgg

SEQ ID NO: 302327 - DNA, 659 bp, Homo sapiens
  misc_feature: GZ8MTXP01EG26F.52.78.H01.1.454.CMB.2.raw
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggaggcttggtccaggccgtgggggtccctgacactctcctgtgtacncctgtggattcaacctttaacagttatggatgtacttcgggtccncgaggcctccggaggggaaggggctagggaggtgggggtcggcccgagcggtagaaagcagtgagtgggaggtagaggaanaactagtcggacgtactcgtggtaggaacgggtcgtaacttccaacctaccttacgaaggaacaacaaaactagtaacaaacgaactaacaattacgtaacttaccgtaaacctaaaagttcggaacgaccacgtcccgttagaaacctcggtacccggaaggtaccgccgggtaaccgttagttaacgttacgttggtcgacggttagttcggttttacggttggggtattgggttttcgcggtttacgaacccttcgtaacg

SEQ ID NO: 302328 - DNA, 711 bp, Homo sapiens
  misc_feature: GZ8MTXP01ENK6L.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgacaaagcaatagtgttattcggtaccagacagacggaccgaggccgacggtcccccttagttcggtagtatataacgtaagacctatagagacggccctcgaacgggtactcccgtagacgtcggtactttccgtcgtcggcctccctccgtaacgaacgggtaacaaacgtacgtactacgttagtaactactactacgtaggttcgggacggtacccggggacgaaggggaacgggtaacgggacggtaccgttacgggtaactttaacttaacggttacgttaaacgtaaacttaacaaacccgtaaggtaaaccgttaagtaaccgggtttaggttaaaccgtttagtaggttaccggtagttacggggttaacgggtacgggaacgggacgaaacggtacgtacgggttaccgttacggttagtaaccgacgaaccggtaacggcccttccggtccccgttcggttaacccc

SEQ ID NO: 302329 - DNA, 648 bp, Homo sapiens
  misc_feature: GZ8MTXP01BU22M.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctcgtggagatgcactgaccaaagcaatatggttattggtacagcagacggccaggcccacgggtaccccccttagttggtagattaagtataaagggaaccctagtacggaaggtaccggaccccttacggaacgggggtaccttccccgttagaacgtcggtactttcccgtcgtcggtccctcctcccgtaacgacgggtaactaaccgagttaccacgttcgatctagtccgaaggtggacggtcccggggagaaggacgggacgacggtcgtaacggtactaagtttacgcttacggaaactacaaacagactgtagttagtacttgtacgtgtcgtaggttcgggaggttaaggaccaacggtcgtaacgttccggttcttacgggcaccggtccgaacgggccttacccgtccccgttcgtcccc

SEQ ID NO: 302330 - DNA, 548 bp, Homo sapiens
  misc_feature: GZ8MTXP01EL2ZU.52.78.H01.1.454.CMB.2.raw
  modified_base (278)..(278): a, c, t, g, unknown or other
  misc_feature (278)..(278): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
  modified_base (539)..(539): a, c, t, g, unknown or other
  misc_feature (539)..(539): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtacagcagagcaggcacggcccttatgnatatataagacatgagagccctcgagggctacccgtgagcgattctctcggctacctcgtcacgggaacaacngtactacgttgatcatcagtggacgtccggnaggaggacgagggctaggacttattacgtntacaatacaacgagaacagtagttaggttacttatggtgtacgtagttcgggcgggaaggaccaagcgttacgacccggtcgttaacgttcgacgaacccgagtccgtccgccccgttggtaacccncgtttccgg

SEQ ID NO: 302331 - DNA, 566 bp, Homo sapiens
  misc_feature: GZ8MTXP01CE5Z1.52.78.H01.1.454.CMB.2.raw
  modified_base (407)..(407): a, c, t, g, unknown or other
  misc_feature (407)..(407): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgaccaaagcaatatggttattggtacagcagagccaggccacggccccttatcggtgatatataaggaccatgagacggccctagagggactccctgacgcgtattccctcgtggcctcctccctacgacgggaacaacgtagtcacgttgactcaatcaggtggacggtccgggngaggaggacggaggtctagattaacttacgtgtacaagtacaacacgactagtagtaggttactgtagtncgtggttccgggnggttagggaccgaaggtctcggaccgttcgttacggtcgacggccaacggccttccgtccccgttaacgggttccc

SEQ ID NO: 302332 - DNA, 667 bp, Homo sapiens
  misc_feature: GZ8MTXP01BLD56.52.78.H01.1.454.CMB.2.raw
tcagcgcagtacgacacgaccggtgctcgatttagtgtgagtagtttgggtttgggtgtgggtccaggaggcagaactctgggtgtctcaccatggcctggatccctctacttcctccccctcctcactctctgcacaggctcgtggggcctcctatgaactgacacagccaccctcggtgtcagtgtcctcaggacagacggccaggatcactgctcgtggagatgcactcgaccaaagcaatataggttatggtaccagcgaggaggccgaggccgacggtcccctttagttcggtagtaatagtaagtaaacggaccagtagacggacggccctacggacgggacttcccgagacgcgtacttctccgtcggtctccctccgtacgaacgggaacaacgtacgtacgtacgttagacgtacactacgaggttcgggacgggttaccgggacgaacggggaaggaccgggtaggtctaacggtaacttaacttacgtagtacaaacgtacaaacgtaagtaacgtaagttaggttggttaattagtaggtcgtaccggtagggttccggggaagggaacgggaccgaaacggcgtaccgggtccgttacgttcgggttacaacgggacccctaagggccctcccggccccgtcgttaacctcccg

SEQ ID NO: 302333 - DNA, 715 bp, Homo sapiens
  misc_feature: GZ8MTXP01D64W6.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggactcacctgctcgtggagatgcactcgaaccaaagctaatagttggttagtacgtacagacgaggacggacgacggaccgtaccggtacccttagttggtagtataagtaacgtaacgactagtagacgacgtaccgtacgacggtactaccgtacgacgtacgtacttcccgtcgtcgtccctccctaccgtaaccgaacggaacaacgtacgtacgtacgtagactactacgtacgtacggtacgggtacgggtaccggacggaacgggaacggacggtacggtacgtacgtaacttaacgttacgtacgtaacgtaaacgtaaccgaaacgtaacgtaaacgttaagttaacggttacgtttaacgttagttaggtacggtacgtacgggtaacgggacgggaacgggtacgttaacggtaccgttacgttaccgttaccggttaccggtaaccgaccggtaacccggtaccggtcccgttccccggtccccgttccggtcccg

SEQ ID NO: 302334 - DNA, 666 bp, Homo sapiens
  misc_feature: GZ8MTXP01AZUWE.52.78.H01.1.454.CMB.2.raw
  modified_base (243)..(243): a, c, t, g, unknown or other
  misc_feature (243)..(243): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatccactgctctgganatgacactgacaaagcaatagtggttattcggtacaggacaggacggccgaggccacggtcccccttagttggtactatagtaacgttaacggacctagtgaacggcggtcccgtaccgacgggtactcccgtgacgacggtacttccgtcgtcggtcctcccgtaccgtacggaacgggacctaacgtacgtacgtacgttaggtactctaacgtcgtaggtacggggaaccggtccgggacgtaacggggtacggaacgggggtacggtacgtaccgtaacgtttacgttaccgtagtacctaaacgtccaaacggtacacgtaagtaagttacgttaacgttgttagtcggtacgttacgggttccgggacggtaacgggaccgtaaggccgttacggacccgtaacgttcggtaacccg

SEQ ID NO: 302335 - DNA, 662 bp, Homo sapiens
  misc_feature: GZ8MTXP01CZ6YM.52.78.H01.1.454.CMB.2.raw
  modified_base (232)..(232): a, c, t, g, unknown or other
  misc_feature (232)..(232): n is a, c, g, or t
  modified_base (480)..(480): a, c, t, g, unknown or other
  misc_feature (480)..(480): n is a, c, g, or t
  modified_base (630)..(630): a, c, t, g, unknown or other
  misc_feature (630)..(630): n is a, c, g, or t
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctggggcctcctatgaactgacacacgcccaccctcggtgtcagtcgtcctcgaggacagacggccaggactcacctgactcgtaggagntgcactgaccaaagctaatagtggttattacgaccagcgaggacggcacggccacggtccccttagttggtatataataagtaacgaccagtaggacgacggtcctacgacggtacctccgtagagtacgtactttcgtcgtcccggtcctccgtccgtacgacggtaaaccaaacgtcgttacgtaccgtttagactactacgtcgacgggttcggacggaccgggacgagggacggaggtaccggntaccgtacgttagtactacgtacgtaacactaaacgagtaaccgtaagtagtcggttactagtagtcgtacgtacggttcgggacgggtaacggaaccgttggtacgttacggtacccgtcggttacgccgacccgaacgcggtaacccnccgtccccgttaccgtccggttaaccttcccg

SEQ ID NO: 302336 - DNA, 726 bp, Homo sapiens
  misc_feature: GZ8MTXP01DWV6N.52.78.H01.1.454.CMB.2.raw
  modified_base (180)..(180): a, c, t, g, unknown or other
  misc_feature (180)..(180): n is a, c, g, or t
  modified_base (226)..(226): a, c, t, g, unknown or other
  misc_feature (226)..(226): n is a, c, g, or t
  modified_base (449)..(449): a, c, t, g, unknown or other
  misc_feature (449)..(449): n is a, c, g, or t
  modified_base (531)..(531): a, c, t, g, unknown or other
  misc_feature (531)..(531): n is a, c, g, or t
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctgggcctcctatgaactgacacagcccaccctcggtntcagtcgtcctcaggacagacggccaggactcacctgctcgtgganatgcactcgaccaaagctaatagttaggttacttacggacagacgagacggcgacggccgaccggtccccttagttaggtgtaacgtaataagtaaacggacctagtaggacgacggtacccgtacgtacgggtacctcccgtagacgtacgttaacgttccgtcgtcccggtaccttacccgtccgtacgaacggggaaaccaacgtaacgtcgttacgtanactaccaggtacgagggtacggtacggacccgggagacggaaggtacgacggtacggtactaacgttacgttactacggtanaacttaacaaacgagaacgtaaggtaaccgttagttacgttagtagttacgtacggttacggttcgggcggggtaaaccggaacgttacgggtaccgttaccggtaccgttacccggttaacgttccgaaacggtcccgtaaaccgttcccggtcccgtccccggttccggtaaccgttaacccggttttccccg

SEQ ID NO: 302337 - DNA, 659 bp, Homo sapiens
  misc_feature: GZ8MTXP01A6EWN.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacacgccaccctcggtgtcagtgtcctcaggacagacgccaggatcactgctctgagatgcactgacaaagcaatagtggttatcggtaccagcagagcacggccacgcccctttagtggtgaatatagtaaacggaccagtggaacgaccggtcccgtacgacggggtacctcccgtaggaacgtcgttacttcccgtcgtcggtccctaccctccgtaacgacgggaaccaacgagtctacgttgactcgtaactgacgttggacggtcgggcgaaggacgggacgtacgcgttacgaaactttacgttacgttagaacgtaaacgtaccaaaccgtaagtaaaccgtaaggttaagttaggtttaaccttagtggttgaacggtggggttaaccgggcgggaaacggacccgaaaggtccgttacggacccgttcggttacggccgaccgaaccgaacgggtcccttcccgtccccgttcggtaaccccg

SEQ ID NO: 302338 - DNA, 707 bp, Homo sapiens
  misc_feature: GZ8MTXP01APCL8.52.78.H01.1.454.CMB.2.raw
  modified_base (252)..(252): a, c, t, g, unknown or other
  misc_feature (252)..(252): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacnctctcctgtgtagcctcgtggtacttctacctttaacagttattggatgtacgttcgggtcccgccgaggcctccggaaggggaacggggcgtgggaggtggggtggccgaggcgtagaagcagtggacgtgggaggtggaaggaagaactagtcggcgtactcgtagtagggaacgggccgtaacttcccaacctaccgttaccgaagaacgaaacaaacgtactaacaaaacgtaacctacgtaaagttcgttaaacctaccttaaccgtaaaagtcggaaccgaccgaaccgtccccgtagaaaccccgtacgtaccccgggaaagggtaacccggtcccgggtaacccgtttagttaaaccgtttaaccgttgggttaccgacggttaaaggtttcgttttacggttaaggggtactttgggttcggttacggttcaaccgttaaccgtcg

SEQ ID NO: 302339 - DNA, 651 bp, Homo sapiens
  misc_feature: GZ8MTXP01B9WTL.52.78.H01.1.454.CMB.2.raw
  modified_base (230)..(230): a, c, t, g, unknown or other
  misc_feature (230)..(230): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctggtgtcagtgtcctnaggacagacggccaggactcacctgctcgtggagatgctactcgaccaaagactaaatagttggttattcggtaaccagcaggacggtccgacggccgacggtccccctttagttcggtagtataagtaataaacggaccagtacgacggacggccctacggacggtaactacccgtggacgtcgtattcgtcgtcggcttccctacgtacgtaggaaccaactacgtactaccgttgtactcgacgtacgtaaggtcgggacggttccgggggagtacggggaacggtacggaggtccgtaggtaacttacgttaacgtacgtaactaagtaacgaaacctaagttacggtaagttacgtagggttaacttagttgttacgtcgtacggttcggacgggacggacgtaacgcgtaaccgg

SEQ ID NO: 302340 - DNA, 695 bp, Homo sapiens
  misc_feature: GZ8MTXP01A0EU2.52.78.H01.1.454.CMB.2.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttcgtgtaggctatttagaaggtgtccagtgtgaggcgcaggctggtaggngtcggtgggggagtcgttggtccngtccggtcgggggtccctagaccactctcctgtgtacgtcctcgtaggtacttacctacctttaagagttagttacggagtgtacgttcggggtcccacgacggtccgtacggaaggggaggtcgtagggagggttgggacgacccgaaggccggttaggaaacgcgtagtaggtacggtagggtagggtaggaaggtaacggtaaacgttacggtcggtacggtacgtacggtacggtacgggtacggtacgtacgtacctaccgtaccgtacgaacgaacgtaacgaacgtaacgtaacgaacgtaactactaactacgtacgtacgtaacgtaacgtacgacgacgtacgtacgacgtacgtaccgtacggacggacggtacggtaacgtacgttacgtcgttcggtcggtacggttacgttcgttcggttggttgttcgttgtcgttcgtcgcgtcg

SEQ ID NO: 302341 - DNA, 738 bp, Homo sapiens
  misc_feature: GZ8MTXP01AK16X.52.78.H01.1.454.CMB.2.raw
  modified_base (212)..(212): a, c, t, g, unknown or other
  misc_feature (212)..(212): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttcctcccctcctcactctctgcacaggctctggggcctcctatgaactgacacagcccaccctcggtgtcagtcgtcctnaggacagacggccaggatccacctgctcgtggagatgcactcgaccaaagacaatagttggttattacggtaccagacaggacggccgaagggcccaccggtccccctttagttcgggtagtaagttaataacgtaaacggacctagtacggaaggaccgggccccttaccggaggggtactcccgtagacgtaacgtctttctcgtcggtccctccgtacccgtagaacgggaacctaaccgtagtaccgtacggttacgtaacttacaacgttacgtaagggtcggggttacgggtacccgggacgtaagggaaccgggacgggggtaacggtacgttacggtaactttaacgtttaaccgtagtacctaaaacttccgtaaacaaacggtaacctaaaggggttaacgtaagggtttaccttaagttcggttacggtggttaaacggggtttcggggaaccggggtaacgggaacccgaaggtcccggtacggttaacccggttcgttaacgggtaaccccgg

SEQ ID NO: 302342 - DNA, 632 bp, Homo sapiens
  misc_feature: GZ8MTXP01D7PHR.52.78.H01.1.454.CMB.2.raw
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
  modified_base (455)..(455): a, c, t, g, unknown or other
  misc_feature (455)..(455): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacacgcccaccctcggtgtcagtgtcctcaggacagacggccaggatcacctgctctggagatgacatcgaccaaagcaaatagtaggttaattggtaacccaggacaggacggccaacggcccgaccgtcccccgttagttggtagtatatagtaagaccatgagacggcctcgaggactcccgngacgcgtattctntcggtcctcctcctgaacgggactaaacngttcacgttgtaatcccaattcggaagtcggggacgtaccggggnaaggacgggacggggaggtactagtaacttacttaccgttgtaactaaactccaaaagacgtaaccgtaaggtaaggttaccgttagttagttacggtagtacggttacggttccggggaacgggtaacgggaaccggtaagccgttacggacccgtttaaccgaacgggtaacccg

SEQ ID NO: 302343 - DNA, 646 bp, Homo sapiens
  misc_feature: GZ8MTXP01DT3IX.52.78.H01.1.454.CMB.2.raw
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
  modified_base (526)..(526): a, c, t, g, unknown or other
  misc_feature (526)..(526): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctgggcctcctatgaactgacacagccaccctcggtgtcagtgtcctcaggacagacgccaggatcacctgctctgganatgcactgaccaaagcaatatggttattggtaaccngcaggacgccgaggccacggtcccccttattcggtagatataagtaaggaccatagagacggccctacgacgggtactcccgtagacgtaaccgtatttccgacgttcggtcccttcccgtaccgtacgtacggggtaacccaaacgtacgtaccgtaccgttagaacttcctaagttccgaaggttacgggacggttacccgggcgaagggacgggtacggacggtccgtaaggtaacttagttaaccnggtaacaaactccgaacaacggtacaaggttaagtcggttaacttaggttacgtgtccgttagggttccggacgggaaggaccaacggtcgtacggacccgttcgttaacgggtaacccg

SEQ ID NO: 302344 - DNA, 693 bp, Homo sapiens
  misc_feature: GZ8MTXP01DI3GQ.52.78.H01.1.454.CMB.2.raw
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggagtcgtgggggagcgttggtccagccgtggggggtccctgacnctctcctgtgtgcctctggattcactttaacagttatggatgacttggccncaggctcgagggaggctggagtgggtgccagcgtagaagcagtgagtgggaggtggaaggaagaactatcggacggtacctcgtggtacggaacggggtccgtattacccgaaccctaaccgtttacccgaaagggaactaaaccaaaaccgtattaaccgaaaacggtaaaccttacaaaagttcgttaaacctttccgttaaacccctaaaagttcgaaccgtaccgaacggtaccccttaggaaaccctacggttacccggaagggaacccgtaccgggtcccgttaggttaccttaacgttcgggtgtaaccgggttacgtttcggtttcggttttaagggggctttgggtttcggttcggttacggtcccttaaccgtccgg

SEQ ID NO: 302345 - DNA, 705 bp, Homo sapiens
  misc_feature: GZ8MTXP01EN9KO.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacacgccaccctcggtgtcagtgtcctcaggacagacggccaggatcacctgctcgtggagatgcactacgaccaaaagactaaattagttagggtttattacggtaaccacggacaggacggccgacggtcccgaaccggtacccccttagtttggtacgtaattaaagtaacgtaaacggacctaagtaggaacggacggtccctacgacgggtactcccgtagacggcgtacttccctacgtcggtccctcccgtccgtaacggaacggtaaccgaaacgtacgtacgtacgttagactactacgtcgaaggtggaacgggtccggacgagggtacggacggtacggtaccgtagtactaacgttacgtacgttaacgaaacttacaaacgtaacgacgtaaggttacgtagttaagtagttggagtaccgagggtcccgggaaggaccgggtaacgacggtcgtaccggttaccgttacgttacggtccaccggtcccgtaacggtcccttaccggtccccgttggttaaccccg

SEQ ID NO: 302346 - DNA, 591 bp, Homo sapiens
  misc_feature: GZ8MTXP01CMOHN.52.78.H01.1.454.CMB.2.raw
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
  modified_base (519)..(519): a, c, t, g, unknown or other
  misc_feature (519)..(519): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcacctgctctggagatgcactgaccaaagcaatagttggttattggtacagcagacggcgaggccacggtccccttatggtnatatagtaagaccatgagacggcctagacggatcccgtagagcgtatctcgtcggcctctccgctacgggaacaancgtctacgtagatacagtcagtcgggacgtcgggacgaggagggacgaggtcgagtaacgttatacgtagtactaaactacgaaacgtacgaatacgggtagtagttaacttgtagtagtctacgggttcggcggggaacgaacgacggtcncggtaaccgtcgttacgggttcaccggtaaccgaacgtccctaccgccccttcggtcccaaccgtttccccg

SEQ ID NO: 302347 - DNA, 497 bp, Homo sapiens
  misc_feature: GZ8MTXP02HNPXB.52.78.H01.1.454.CMB.2.raw
  modified_base (465)..(465): a, c, t, g, unknown or other
  misc_feature (465)..(465): n is a, c, g, or t
tcagcgcagtacgacacgaccggtgctcgatttagtgtgagtagtttgggtttgggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggccccctatggtgatatataaggaccatgagaggcctcagggatccctgagcgattctctggctcctcctcagggacaacagtcacgttgatcatcagtgagtcggcaggaggacgaggctgactattactgtcaatcaacagacagtaagtggtacttatgttgcgagttcggnggaagggccaaaggctagaccgtcgtagtccg

SEQ ID NO: 302348 - DNA, 510 bp, Homo sapiens
  misc_feature: GZ8MTXP02H3VQ9.52.78.H01.1.454.CMB.2.raw
  modified_base (299)..(299): a, c, t, g, unknown or other
  misc_feature (299)..(299): n is a, c, g, or t
  modified_base (479)..(479): a, c, t, g, unknown or other
  misc_feature (479)..(479): n is a, c, g, or t
tcagcgcagtacgacacgaccggtgctcgatttagtgtgagtagtttgggtttgggctggggagcctagctgtgctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggttattggaccagcagagccaggccaggcccctatggngatatataaggaccatgagaggccctcagggactccctgagcgattcgtctggcctcctcctcagggaccaacagtcacgttgactcatcagtggacgtcggcaggaggacgaggctaggactattactgtactaatacaacagactagtagtaggttacttagtagttgctagttcggnggaaggaccaagctaggaccctcgtaagccg

SEQ ID NO: 302349 - DNA, 508 bp, Homo sapiens
  misc_feature: GZ8MTXP02INH1E.52.78.H01.1.454.CMB.2.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcagcaggcccctatgngatatataaggacatgagagcctnaggatccctgagcgattctctcggctcctctcgaggacaacagtcacgttgatcatcagtgagtccggnagaggacgtaggctagactatactgtacaatnaacagacagtagtgtattangtagctaaggttcgacggacgggaccaaagctagaaccgtctaacggtcacgcccgaaaggcctcgcccccttcggaccacgttcccg

SEQ ID NO: 302350 - DNA, 475 bp, Homo sapiens
  misc_feature: GZ8MTXP02IMR3O.52.78.H01.1.454.CMB.2.raw
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctggggcctcctatgaactgacacagccacctcggtgtcagtgtcctcaggacagacggccaggatcacctgctctggagatgcactgccaaagcaatatggttatggtacagcagagcagcagccctatgtnatanatagacatgagaggcctcgaggatcctgagcgatctctggctcctctcaggacaacngtcacgttgatcatcagtgagtcggcaggagacgagctgactagtacngtacaatacaacagacagtagtgtatatgtacgctagtcgcggaggacaagcgtagaccgtcaacggtcagccaaggctcgccctcggtcactc

SEQ ID NO: 302351 - DNA, 502 bp, Homo sapiens
  misc_feature: GZ8MTXP02G0JW6.52.78.H01.1.454.CMB.2.raw
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (427)..(427): a, c, t, g, unknown or other
  misc_feature (427)..(427): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccaggcccccttatgngatatataaggaccatgagaggccctnagggatccctgagcgattcctctggctcctcctcacggggacaacagtcacgttgatcatcagtggagtcgggnagaggcgaggctgactatactgacaatcaacagacagtagngtattatgtgcaggttcggaggagggaccaaggctagaccgtctaggtcacgcccaagcgtcgcccccgtggtcc

SEQ ID NO: 302352 - DNA, 517 bp, Homo sapiens
  misc_feature: GZ8MTXP02IFMVE.52.78.H01.1.454.CMB.2.raw
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctggggcctcctatgaactgacacagcccaccctcggtgtcagtgtcctcaggacagacggccaggatcacctgctctggagatgcactgccaaagcaatatggttattgtacagcagagcagcaggcccctatgtgatatataaggacatgagaggcctcagggatccctgagcgattctctggctcctctcaggacaacagtcacgttgatcatcagtgagccggganagaggagagctagactattatgtacaatacaaanagatagtagtagtagttatagtgtgtagtcggtacggacggacgaacgacgtacgtaccgtaccgtacgtacgacgaaccgaacggacgtccgtacccgtccgtaccgtactcg

SEQ ID NO: 302353 - DNA, 512 bp, Homo sapiens
  misc_feature: GZ8MTXP02GWR2L.52.78.H01.1.454.CMB.2.raw
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttatcggtgatatataaggaccatgagaggccctcagggatccctgagcgattctctggctcctcctcagggacaacngtcacgttgatcatcagtgagtccggcagaggacgaggctgactatacngtanatcaacagacagtagtggtacttatgtagcgtagttcggcggacgggaccaaggctggaccgtcgtaggtcacgcccgaaggcctcgcccccgtcggcacgttcc

SEQ ID NO: 302354 - DNA, 490 bp, Homo sapiens
  misc_feature: GZ8MTXP02GZ8SJ.52.78.H01.1.454.CMB.2.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccctatgngatatataaggacatgagaggcctnagggatccctgagcgatctctggctcctctcagggacaacngtcacgttgatcatcagtgagtcggcagaggacgaggctgactatacngtacaatcaacagacagtagtagtactatgtgcagtcgcggtaggaccaaagctgaccgtcaggtcacgccgaaggctcgcccctggccacgtcc

SEQ ID NO: 302355 - DNA, 513 bp, Homo sapiens
  misc_feature: GZ8MTXP02JHK3K.52.78.H01.1.454.CMB.2.raw
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcgagggatccctgagcgattcctctggctcctcctcagggcaacagtcacgttgatcatcagtggagtccgggcagaggacgagctgactattacngtacaatcaanagacagtagtggtacttatgtagcgagttcggcggagggaccaaaggctagacccgtcgtaaggtcagacccgaggcctcgccccctggtcc

SEQ ID NO: 302356 - DNA, 773 bp, Homo sapiens
  misc_feature: GZ8MTXP02HHQAA.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggcaggccacggcccccttagtcggtgatatagtaaggaccatagagaacggccctacgaggggatccgactgagcgtacttctcgtggtcctccctccgtacgacggggacaaacgacgtaccgtacggtttacgaacttcactaccgtaggtacggtacggtacccgggacgacgggacgggaaacgggacggtacgtacgtaacgttaaacgtttaaccgtttacggtaaccgttaaacgttaaccgtaaaactaaacggaaaaccgtaacgggttaaagggtttaaccggggttaaactttttaacggttaaagggttgggttaccggttaaaaccgggtttcccgggggttacggggtaaaccgggggtaaaccggaaaccggtaccgggtaacccggttaacccgggttacccggttaaaaccgggttcccggtaaaacccggtaaccccggaacccgggtaacccggtcccccgggttaaccccccggtttaccccccgggg

SEQ ID NO: 302357 - DNA, 525 bp, Homo sapiens
  misc_feature: GZ8MTXP02GGEZR.52.78.H01.1.454.CMB.2.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattgtaccagcagagcaggccaggccccttatggngatatataaggaccatgagaggccctcgagggactcccgtgagcgattctcgtcggctccctctcgagggaaccaacgngtcacgttgactcactcagtggagtcccggagagaggacgagctagactatacngtanaatacaacagactagtagtacgtattagtgtgcgtaggtcggcggacggacctaagcgtagccgtcgtacgcacgaaccgaggtctccgccctcggtcacttcccg

SEQ ID NO: 302358 - DNA, 540 bp, Homo sapiens
  misc_feature: GZ8MTXP02IC02X.52.78.H01.1.454.CMB.2.raw
  modified_base (357)..(357): a, c, t, g, unknown or other
  misc_feature (357)..(357): n is a, c, g, or t
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagttggtgatatataaggaccatgagaggcctcgagggatccctgagcgattctctgcctcctctcgaggacaacngtcacgttgatcatcagtggagtccggacagaggacgagctgactatacngtacatcaactagacagtagtggtacttagtgtagntaggttcggacgggaacgggaccaaggcgtacggaccgttaccgtacggtcacggaacccgaacggccgtccgcccccgtcggtaccaccgttcccg

SEQ ID NO: 302359 - DNA, 508 bp, Homo sapiens
  misc_feature: GZ8MTXP02JWQLD.52.78.H01.1.454.CMB.2.raw
  modified_base (416)..(416): a, c, t, g, unknown or other
  misc_feature (416)..(416): n is a, c, g, or t
tcagcgcagtacgacacgaccggtgctcgatttagtgtgagtagttgggtttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggccccttatggtgatatataaggaccatgagaggccctcagggatccctgagcgattcctctggctcctctcagggcaacagtcacgttgatcatcagtggagtcgggcagaggacgaggctggactagtactgtacaatcaangacagtagtggtaactatgtgcaggttcggcggagggaccaagcgtcgaccgtccgtaaggtcgagcccgaaggcctacggccccctggtcc

SEQ ID NO: 302360 - DNA, 544 bp, Homo sapiens
  misc_feature: GZ8MTXP02J5YMX.52.78.H01.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctggtgtcagtgtcctcaggacagacggccaggatcacctgctctggagatgcactgaccaagcaatatggttatgtacngcagngccagccacgccctatgngatanataggaccatgagacgccctagacggactccgtgagcgtactcgtctcggcctcctccagacggacactgtcacgttantnatgagtgacgcggacgaggacggagagctagtactattacgtactacacacgaacgagtagtaggttagtagttacgttagtgtacgacgtacggtacgggacggaacggacgacgtcgtaccgtaccgtaccgtacgaccgaccgaaccgacgtccgtcccgtcccgtacgtacctacctccg

SEQ ID NO: 302361 - DNA, 725 bp, Homo sapiens
  misc_feature: GZ8MTXP02HD1TM.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtaccagcagagcagccacgtccccttagtgtgatatataaggaccatagagacggccctacgagggactcccgtagacgcgtacgttccctcgtcggtccctaccgtcctcgaacgggacctaaacgtacggtacctaaccggtttgaactaccgtaacgtacgtaacggttacggggaccggttacccgggggaccgaaggggaaacggggacccgggaagggtacccgtaggtaaacttaacgtttaacgtacggttaaccaaacgttaccaaaaccgaggtaaccgtaaggttaacgggttaggttaactttaaggttggttacggtacgttacggggttaccgggggacgggtaaccggggaaaccgtaacggaccgttaccggaacccggttaccgtaacggggtaacctaccggtaacccggaacgggtacccgtacccggtaccccccggtacgggtttaccccg

SEQ ID NO: 302362 - DNA, 553 bp, Homo sapiens
  misc_feature: GZ8MTXP02FZ5RB.52.78.H01.1.454.CMB.2.raw
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (404)..(404): a, c, t, g, unknown or other
  misc_feature (404)..(404): n is a, c, g, or t
  modified_base (442)..(442): a, c, t, g, unknown or other
  misc_feature (442)..(442): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctcgtggagatgcactgaccaaagcaatatggttattggtaccagcagagccaggccaggcccctatgngatanataaggaccatgagagccctnagggactcccgtgagcgattcctctggctcctctcagggacaacagtcacgttgatcatcagtggagtcggcagaggcgaggctgactattacngtacaatcaaacaggaacaaggtagtaggtacttaagngttagctaaggttcggcggaggggtacccaaaggtcgtacggtaacccgtcccgttagggtaaccgacggaccccgaaaggggcccttacggcccccccttgggttacccc

SEQ ID NO: 302363 - DNA, 541 bp, Homo sapiens
  misc_feature: GZ8MTXP02IVFAO.52.78.H01.1.454.CMB.2.raw
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggacatgagaggcctnaggatccctgagcgattctctcggctcctcctcagggacaacngtcacgttgatcatcagtgagtcgganagaggacgaggctgactatactgtacaatacaaatagaacagtagtaggtaacttatgtagcgtaggttcggacgggtagggacccgtaaaggcgtacgacccgttccgtacggtccaacgcccgaaacggccgtccgcccccgtcggtacctacgttcccg

SEQ ID NO: 302364 - DNA, 538 bp, Homo sapiens
  misc_feature: GZ8MTXP02F6A2I.52.78.H01.1.454.CMB.2.raw
  modified_base (308)..(308): a, c, t, g, unknown or other
  misc_feature (308)..(308): n is a, c, g, or t
  modified_base (497)..(497): a, c, t, g, unknown or other
  misc_feature (497)..(497): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtctgggggaggcttggtccaggccgtggggggtccctgacactctcctgtgtagcctctggattcacctttaacagttatggatgacttgggtccncaggctccgagggaggggctggagtgggtggccagcgtgaagcatgatggaggtgaggaagactagtggcggactcgtgtgaaggggccattcaccacttccaagacgaacaaacatacaaagaactacaaattgtaatctaccaaaatgaagcaagcctagacatccgaagcaacggcctgtattacngtgcgagtagtttcgttgggattcggttgtcgttgctacag

SEQ ID NO: 302365 - DNA, 504 bp, Homo sapiens
  misc_feature: GZ8MTXP02GY40N.52.78.H01.1.454.CMB.2.raw
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggccctcgagggactccctgagcgtattcctctggctcctctcagggcaacngtcacgttgatcatcagtggagtccggnagagcgagcngactatacngtacaatcaanagacagtagtaggtactatgtgcagttcggcggaggaccaaagctacgaccgtccgtagcacgaccgagcctacgcccctcggtcc

SEQ ID NO: 302366 - DNA, 519 bp, Homo sapiens
  misc_feature: GZ8MTXP02JV73O.52.78.H01.1.454.CMB.2.raw
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagagccctcagggactccctgagcgattcnctggctcccgtcctcgagggacaacagtcacgttgatcaatcagtggagtccgggnacgaggacgaggctgactattactgtctaaanacaacagactagtagtagtactagtgtgcgtacggtcggacggaggaccacgcgtcg

SEQ ID NO: 302367 - DNA, 563 bp, Homo sapiens
  misc_feature: GZ8MTXP02GMW5L.52.78.H01.1.454.CMB.2.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatgtacagcagagcagcaggcccctatgngatatataaggacatgagagcctnagggatccctgagcgatctctggctcctcctcagggacaacngtcacgttgatcatcagtgagtccggnagaggacgaggctgactatacngtacaatcaacagactagtagtaggttattaagtgtgctacgggttcgggacgggtaacggggaacccgaaaggtccgtacggtacccggttaccgtaacgggtaccgaacggaaccccgaaacgggtcccgtcccggtaccccccgttacgggtccctaaccgtttcccccg

SEQ ID NO: 302368 - DNA, 490 bp, Homo sapiens
  misc_feature: GZ8MTXP02HX1KV.52.78.H01.1.454.CMB.2.raw
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (343)..(346): a, c, t, g, unknown or other
  misc_feature (343)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (366)..(367): a, c, t, g, unknown or other
  misc_feature (366)..(367): n is a, c, g, or t
  modified_base (370)..(370): a, c, t, g, unknown or other
  misc_feature (370)..(370): n is a, c, g, or t
  modified_base (372)..(373): a, c, t, g, unknown or other
  misc_feature (372)..(373): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctnaggacagacggccaggatcacctgctctggagatgcactgcaaagcaanangtatgtacagcanagcagcaggcccctactgtgananataagacatnanagccncngancnnnntntngcncncncagacacannatnannatnagngngtcggacgagaggagagngagactatactagtacaanacaacaacganaacgtagtacgtacgttacgtagtagtcgacggtacggtacggacggaacgaacgacgtcg

SEQ ID NO: 302369 - DNA, 527 bp, Homo sapiens
  misc_feature: GZ8MTXP02JMPS7.52.78.H01.1.454.CMB.2.raw
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
  modified_base (441)..(441): a, c, t, g, unknown or other
  misc_feature (441)..(441): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagcgtcctcaggacagacggccaggatcacctgctctggagatgcactgaccaaagcaatatggttatggtaccagcagagcaggccaggcccctatggtgatatataggacatgagagccctgaggactccctgagcgtatctctcggccttcctcctcgacgggacaacncggtacacgttgactcatcagtaggacgtcgggnacggaggacgagcagactattactgtcaatcaacagacagtagtggtacttatgngtcgtaggttcggagggacggacgaagcgtacgaccgtcctaggtcacgcccgaaggcctccgccccgtcggttaccacgttcccg

SEQ ID NO: 302370 - DNA, 586 bp, Homo sapiens
  misc_feature: GZ8MTXP02HAU3L.52.78.H01.1.454.CMB.2.raw
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggccccttatgngatatataaggaccatgagaggcctcagggatccctgagcgattcctctggctcctctcgagggacaacagtcacgttanatacatcgagtggacggtccggacgaaggacggacggacggactagtacttaacgttacgtagtaactaactacgaaacgtagaacgtaaggttaagtacggttaacttagtagtacgtacgtacggttacgggacgggaacggaacgaacgtacgtaccgtaccgtacgtacggtaacgaaccgacccgacggtcccgtcccgtcccccgtacggtaccg

SEQ ID NO: 302371 - DNA, 547 bp, Homo sapiens
  misc_feature: GZ8MTXP02HTOKD.52.78.H01.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagaggccaggccaggcccccttattggngatatataaggaccatgagaggccctcgagggactcccgtgagcgattcctctggctcctctcagggacaanacgtcacgttgatcatcagtggagtcgggcagaggacgaggctgactattactgtacaattacaacagacagtagtaggtacttagtgtgactaggttcggacgggaacgggaccaaaggctacggacccgtacgtaggtaaccgacggacccaaacgggtctacccggtccccgtacggtacccg

SEQ ID NO: 302372 - DNA, 503 bp, Homo sapiens
  misc_feature: GZ8MTXP02FUFNW.52.78.H01.1.454.CMB.2.raw
  modified_base (353)..(353): a, c, t, g, unknown or other
  misc_feature (353)..(353): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccccttatggtgatatataaggacatgagaggccctcagggatcccctgagcgattctctggctcctcctcagggacaacngtcacgttgatcatcagtggagtccgggcagaggacgaggctagactattactgtacaatcaaacagacagtagtggtacttatgtgctagtcggnggacgggacaagcngaccgtctaggtcagccaaggctcgccctcggacncgtcc

SEQ ID NO: 302373 - DNA, 500 bp, Homo sapiens
  misc_feature: GZ8MTXP02FQLZO.52.78.H01.1.454.CMB.2.raw
  modified_base (387)..(387): a, c, t, g, unknown or other
  misc_feature (387)..(387): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggtattggtaccagcagaggccaggccaggcccccttatggtgatatataaggaccatgagaggcccctcagggatccctgagcgattcctctggctcctcctcagggcaacagtcacgttgatcatcagtggagtccgggnagagacgagctgactattactgtcaatcaacagacagtagtggtacttangtgcagttcggngaagggaccaagctcgaccgtctaggtcacgccaggctcgccccgtggtcc

SEQ ID NO: 302374 - DNA, 523 bp, Homo sapiens
  misc_feature: GZ8MTXP02JEZ1N.52.78.H01.1.454.CMB.2.raw
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagccagccaggcccctatggngatatataaggacatgagaggccctcgagggactccctgagcgattctctcggctcctcctcagggacaacngtcacgttgatcatcagtggagtccggcagaggacgagctgactagtactgtacaatacaactagactagtagtaggtacttatgtgcgaggttcggcggtagggaccaagcgtagacccgtcgtaacgggtcacgcccgaaggcctccgccccgttcggtccacttcccg

SEQ ID NO: 302375 - DNA, 529 bp, Homo sapiens
  misc_feature: GZ8MTXP02HP20J.52.78.H01.1.454.CMB.2.raw
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (441)..(441): a, c, t, g, unknown or other
  misc_feature (441)..(441): n is a, c, g, or t
  modified_base (467)..(467): a, c, t, g, unknown or other
  misc_feature (467)..(467): n is a, c, g, or t
  modified_base (527)..(527): a, c, t, g, unknown or other
  misc_feature (527)..(527): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggagcttggtccagccgtgggggtccctgacactctcctgtgtagcctctggattcaccttaacagttattggatgacttgggtccnccaggctccgaggggaaggggctggagtggggngccaggcgtgaagcatgatgggaggtgaggaagactatgcggactcgtgtgaaggggccattccaccacttccagagacaaacatacaaagactacaatgtaanctaccgaaatgagacagcctgactanccgagacacggtcgtgtatactgtacgcgagtagttgttggtgttgttgtgtcgtcgacncg

SEQ ID NO: 302376 - DNA, 535 bp, Homo sapiens
  misc_feature: GZ8MTXP02IYOUZ.52.78.H01.1.454.CMB.2.raw
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaggtgtccagtgtgaggcgcagctggtggagtcgtgggggaggcttggtccagccgtggggggtccctgacactctcctgtgtagcctctggattcacctttaacagttattggatgacttgggtccnccaggctccgagggaagggctggagtgggtggccagcgtgaagcatgagtggagtgaggagactangcggatctgtgaagggccgattcacacttccagagacaaacntacaaagaactanaatntatcacaangancagcagacagtccgagacgacggtcgtagttacttcgngtacgcgtagttcgtttcgttgggtattggttcggtcgttcgacctaccgtag

SEQ ID NO: 302377 - DNA, 544 bp, Homo sapiens
  misc_feature: GZ8MTXP02FWO61.52.78.H01.1.454.CMB.2.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctcgtggagatgcactgccaaagcaatntgttatgtaccagcagagcagcaggccctatgngatatataggacatgagngcctcagggactcctgagcgattcnctggctccncctcacgggacaaacgngtcacgttagactacgatcgtagtcggtacgacggacgacggaggacgacggtctagtacgttagttacgtagtactacgtacgtaacgaacgtacgtagtacgttagttacgttacgtacgtacgtacgtacggtacggtacggaacggaacgacgtacgtacgtaccgtacgtacgtacg

SEQ ID NO: 302378 - DNA, 515 bp, Homo sapiens
  misc_feature: GZ8MTXP02JMEDM.52.78.H01.1.454.CMB.2.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcagcaggcccctatgngatatataaggacatgagaggcctnagggatccctgagcgattctctcggctcctcctcgagggacaacngtcacgttgatcaattcgagtggacgtccgggacaggaggacgagcgtagactattactgtacatacaacagacagtagtgtacttatgtgcgagttcgggacggtagggaccaagctacggaccgtccgtacggtcacgcccgaaggctcggcccctcggtccactcg

SEQ ID NO: 302379 - DNA, 513 bp, Homo sapiens
  misc_feature: GZ8MTXP02IQKW1.52.78.H01.1.454.CMB.2.raw
  modified_base (349)..(349): a, c, t, g, unknown or other
  misc_feature (349)..(349): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggccaggcccctatgtgatatataaggaccatgagaggcctcagggatccctgagcgattctctcggctcctcctcaggacaacngtcacgttgatcatcagtgagtccggcagaggacgaggctgactatactgtacaatacaactagacagtagtggtactatgtgctagttcgacggaggaccaaaggctagaccgtccgtaaggtcacgaaccgaaggctacgcccccgtcggacctacttcccg

SEQ ID NO: 302380 - DNA, 482 bp, Homo sapiens
  misc_feature: GZ8MTXP02GMBKW.52.78.H01.1.454.CMB.2.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (412)..(412): a, c, t, g, unknown or other
  misc_feature (412)..(412): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcagcaggcccctatgtgatatataagacatgagagcctnaggatcctgagcgattctctggctcctctcagggacaacngtcacgttgatcatcgagtggagtcggacaggaggacgaggctgactatactgtacatacaacagacagtagngtactatgtagcagttggcggaggacaagctgaccgtcgtacgcagccgaaggctcgccctcggcacgtc

SEQ ID NO: 302381 - DNA, 574 bp, Homo sapiens
  misc_feature: GZ8MTXP02I5CP2.52.78.H01.1.454.CMB.2.raw
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccacggccccttatggtgatatataaggaccatgagacggccctcgagggactcccgtgacgcgattctcgtcggctcctctcagggacaacngtcacgtgatcatcagtggagtccggcaggaggagagctgactatacngtacaatacaatagacagtagtacgtattagtggtagcgtaggttcgggacgggtaacgggaaccgaaggtccgtacggtaccgtaccggttaacggtccgaacggaaccccgaaagggtcccgttacccggtacccccgttacgggtccgtaaccctttccccgg

SEQ ID NO: 302382 - DNA, 527 bp, Homo sapiens
  misc_feature: GZ8MTXP02GTPAS.52.78.H01.1.454.CMB.2.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (525)..(525): a, c, t, g, unknown or other
  misc_feature (525)..(525): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccnccaggctccgaggggaggggctggagtggggtgccagcgtgaagcatgatggagtgagganactanggcgactcgtgtgaagggccattccaccacttccagagacaacatacaaagaactacaatagtatacctacaaatcgagcagcctagacatccgagacgacggccgtgtatacgtgtcgcgagtacgttgttggattggttgtcgtcgcacncg

SEQ ID NO: 302383 - DNA, 507 bp, Homo sapiens
  misc_feature: GZ8MTXP02FUEAA.52.78.H01.1.454.CMB.2.raw
  modified_base (280)..(280): a, c, t, g, unknown or other
  misc_feature (280)..(280): n is a, c, g, or t
  modified_base (350)..(350): a, c, t, g, unknown or other
  misc_feature (350)..(350): n is a, c, g, or t
  modified_base (433)..(433): a, c, t, g, unknown or other
  misc_feature (433)..(433): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtaccagcagagcaggccaggcccctatggngatatataagaccatgagaggccctcgagggactccctgagcgattctctggctcctctcagggacaacngtcacgttgatcatcagtgagtccggcagaggacgagctagactatactgtacaatcaacagacagtagtaggtactatgtgntaggttcggaggacggacctaagcgtagaccgtcgtaggtcacgccgaaggctcgccccgtcggccacgttccc

SEQ ID NO: 302384 - DNA, 508 bp, Homo sapiens
  misc_feature: GZ8MTXP02HHVCZ.52.78.H01.1.454.CMB.2.raw
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcaggcaggcccctatgtgatatataaggaccatgagaggccctcgagggactcccgtgagcgattctctggcctcctcctcagggaccaacngtcacgttgatcatcagtgagtccggcaggaggacgaggctgactatactgtacaatacaacagacagtagtggtattagtgtgactagttcggcggagggaccaaggctcgaccgtcgtaggtcacgcccgaaggcctcgcccctggtcactccg

SEQ ID NO: 302385 - DNA, 707 bp, Homo sapiens
  misc_feature: GZ8MTXP02HNZDP.52.78.H01.1.454.CMB.2.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttcgtgtaggctatttagaaggtntcagtgtgaggcgcagctggtggagtcgtgggggnggcgttggtccgacgccggtcgggggtccgtcgacactctctgtgtgctctgtatctacttaactagttagtgtagtgtacgttcggtccgccgacggcgtccgaggggaaggggcggtgggtagggtggggtcgggccgacggcggtaggaagacgtagtaggtagtaggggtagggtaggaagggaaaggtaacgtagtggtacgggtacgtcgttggtagggaacggggaccggtacgttaccgtacctaccgtaccgaacgaacgaaacaaacaactaacaaacgtaaactaactaaactagttacgttacctaaccgtaaagtagaacgacgacgaccgtacgaacgtacgtaccggtaacggaaccggtaaccggtaccggttacggttaacgttacgttacggttacggtacggtacggttacggtttcggtttaagggttaggtttacggtttcggttcggtttcggtaccgtaccgtacg

SEQ ID NO: 302386 - DNA, 519 bp, Homo sapiens
  misc_feature: GZ8MTXP02HENP3.52.78.H01.1.454.CMB.2.raw
  modified_base (279)..(279): a, c, t, g, unknown or other
  misc_feature (279)..(279): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcaggccaggcccctatggngatatataaggaccatgagaggccctcgagggactccctgacgcgattctctggctcctcctcagggacaacngtcacgttgatcatcaggtgagtccggnaggagacgngctgactattactgtacaatcaactagacagtagtggtacttatgtgcgtagtcgggacggacgggaccaagcgtacgaccgtcgtacggtcacgcccgaaggcctcgccccgtcggtaccacgttcccg

SEQ ID NO: 302387 - DNA, 521 bp, Homo sapiens
  misc_feature: GZ8MTXP02JF7YM.52.78.H01.1.454.CMB.2.raw
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcaggccaggccccttatggtgatatataaggaccatgagaggccctcagggatccctgagcgatcctctggctcctcctcagggcaacagtcacgttgatcatcagtggagtcggcagagacgagctgactattacgtgtcaatcaacagaacagtagtgtactagtgtagnagttcgggnggacgggacctaagcgtacggaaccgttcgtacggtaacgacggacccgaaggcctcgtcccccgtggtacccg

SEQ ID NO: 302388 - DNA, 515 bp, Homo sapiens
  misc_feature: GZ8MTXP02I8OYH.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagaggccaggccaggcccccttatggtgatatataaggaccatgagaggccctcagggactcccctgacgcgtattcctctggctccgtcctcagggcaacgagtccacgttgatcgatcagtggagtccgggcaggaggacgaggctgactattatgtacaatcaaacagaacagtagtaggtacttatgtgcagttcggcgagggaccaagctcgaccgtcgtaggcacgccaaggcgtcgcccctcggtacc

SEQ ID NO: 302389 - DNA, 593 bp, Homo sapiens
  misc_feature: GZ8MTXP02GQW2W.52.78.H01.1.454.CMB.2.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttatggtgatatataaggaccatgagaggccctnagggatccctgagcgatctctggctcctctcagggacaacngtcacgttgatcatcagtgagtccggnacgaggacgagcgtgactatactagtcaatacacaagactagtaagtggtacggttaatgtagtcgacgtttaggggtaccgggtaggggaaccggtaaacggaccggtaggtacccgggtaaccccgttaacgggttccggtaacggaaccccggtaaacccgggacgtttacccggacccccggtacccgggttccggtaacccgtttccccg

SEQ ID NO: 302390 - DNA, 592 bp, Homo sapiens
  misc_feature: GZ8MTXP02J5CB3.52.78.H01.1.454.CMB.2.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
tcagcgcagtacgacacgaccggtgctcgatttagtgtgagtagtttgggtttggggctgtgggtccaggaggcagaactctgggtgtctcaccatggcctggatccctctaccttcctccccctcctcactctctgcacaggctctggggcctcctatgaactgacacagccaccctcggtgtccagtcgtcctcaggacagacggccaggatcacctgctctggagatgcactgaccaaagcaatntgttattgacngcagagccagccacggccccttatgtgatatagtaaggaccatgagacggccctgagggacttcccgngacgcgtacttccctctggcctacctcacgagggcaaacagtctacgttnactcagtacgaggtcggacggtcgggacgaggacggtacgacgtctacgtacttattactagtacaactacaacgacgtaacgtaggttagttagttaacgttagtggtacgtacggtacgggtacgggacgggaacgaaccgtacgtccgtaccgtacccgttaccgtacgtccgaccggacccgtacggtcccgtcccggtccccgtcgtacc

SEQ ID NO: 302391 - DNA, 550 bp, Homo sapiens
  misc_feature: GZ8MTXP02G8HHT.52.78.H01.1.454.CMB.2.raw
  modified_base (242)..(242): a, c, t, g, unknown or other
  misc_feature (242)..(242): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtacagcagaggccaggccacggcccccttagttcggtgatatataaggaccatgagacggcctccgagggatccctgagcgattctctcggctccctcctcgacgggacaacgagtcacgttgatcgatcagtggacgtccgggacaggacggacgaggtactagtacgttattaccgtgtacaatacaaacacgaacgagttacgtaggtacttaagtggtacgcgtacggttcggacggaacggaccgaacggctacggaccgtccgtacggtaccg

SEQ ID NO: 302392 - DNA, 544 bp, Homo sapiens
  misc_feature: GZ8MTXP02HWMUU.52.78.H01.1.454.CMB.2.raw
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaaatatggttattggtaccagcagagcagccagcccctatgtgatatataaggaccatgagaggcctcgagggatcccgtgagcgattctctcggctcctcctcgaggacaacngtcacgttgatcatcagtgacgtcggcaggaggacgaggctaggactaattacngtacaaatcaaacagaacagtatggtacttagtgtgctaaggtcgggacggacggggaccaaaggctacggaccgtaccgtacggtacacggaacccgaaacgggccttcggccccccgtcggtacctacgtttccccg

SEQ ID NO: 302393 - DNA, 487 bp, Homo sapiens
  misc_feature: GZ8MTXP02FV0IH.52.78.H01.1.454.CMB.2.raw
  modified_base (377)..(377): a, c, t, g, unknown or other
  misc_feature (377)..(377): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccaggccccttatgtgatatataaggacatgagaggcctcagggatccctgagcgattcctctggctcctctcagggcaacagtcacgttgatcatcagtgagtcggnagagcgagctgactatactgtcaatcaacagacagtagtggtacttatgtgcagttcggcggaggaccaagctcgaccgtctaggtcagcccaaggctcgcccctggtcc

SEQ ID NO: 302394 - DNA, 491 bp, Homo sapiens
  misc_feature: GZ8MTXP02I5E15.52.78.H01.1.454.CMB.2.raw
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggtatgtaccagcagagcagccagccccctatcggtgatatataaggaccatgagaggccctcagggatccctgagcgattctctggcctcctcctcacgggacaaacagtcacgttgatcatcagtgagtcggcagaggacgaggcngacgtatacgngtacatacaacagacagtagtggtatagngtncgagttcgcggaaggaccaagctacgacgtctagtaccg

SEQ ID NO: 302395 - DNA, 540 bp, Homo sapiens
  misc_feature: GZ8MTXP02ILBPK.52.78.H01.1.454.CMB.2.raw
  modified_base (362)..(362): a, c, t, g, unknown or other
  misc_feature (362)..(362): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggcccctgagggactcccgtgagcgattcctctggctcctctcgagggccaacngtcacgttgatcatcagtggagtccgggcagaggacgaggctagatagttactgtacaatacaacagaacagtagtacggtattagtgtgcaggttcgggacggagggaccctaaaggcctacgacccgtcgtacggtaacacggacccgaacgggctccgacccccgttcggtaccc

SEQ ID NO: 302396 - DNA, 507 bp, Homo sapiens
  misc_feature: GZ8MTXP02JHI85.52.78.H01.1.454.CMB.2.raw
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttatggtgatatataaggaccatgagaggcccctgagggatccctgagcgattcctctggctcctcctcagggacaacagtcacgttgatcatcagtggagtccggnagagacgagctgactattactgtacaatcgaanagacagtagtgtactatagtgcagttcggcggaggaccaaggctacggaccgtcgtagcgacgccaaggcctcggccccctggtccc

SEQ ID NO: 302397 - DNA, 533 bp, Homo sapiens
  misc_feature: GZ8MTXP02G4UZC.52.78.H01.1.454.CMB.2.raw
  modified_base (360)..(360): a, c, t, g, unknown or other
  misc_feature (360)..(360): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggtatggaccagcagaggccagccaggccccttagtgtgatatatacggacatgagacgccctgacggattcccgngacgcgattctctcggctaccctccgtacgagggaccaacgtagtacctacgttgactcatacgaagtcggacgtccgggacaggaggacgaggctagactatcgtagtacaatcaacgagacgtagtagtgtacttagngtagngtacgtcggacgtacggaccagcgtacg

SEQ ID NO: 302398 - DNA, 674 bp, Homo sapiens
  misc_feature: GZ8MTXP02GETXT.52.78.H01.1.454.CMB.2.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttcgtgtaggcgtatttagaaggtgtccagtgtgaggcgcagctggtggagtctgggggaggcttggtccagccgtggggggtccctgacnctctctgtgtgcctntggtattctaacctttaanagttatggatgtacgttcggccgccgaggccgtaccggaaggggaaggggcggtggtaggtgggtcggcgaggcggtagaagacgagtagagtagggaggtaggaaggaagaacgtagtcggacggtacgtcgtagtaggaacgggaccgtacgtaccacctacctaccgaacgaacgaaacaaacaactaacaaacgtaaactaactaataagtaactacctaactaaagtagtaacgacgaaccgtaccgtacgacgtacgtaccggaacggaacgtaaccggtaccggttacgttaacgtttacgttacggtacggtacgtacggttacggtttacggtttaagggttaggttacggtttcggttcggttcggtaccgtaccgtacg

SEQ ID NO: 302399 - DNA, 740 bp, Homo sapiens
  misc_feature: GZ8MTXP02HPW4U.52.78.H01.1.454.CMB.2.raw
  modified_base (307)..(307): a, c, t, g, unknown or other
  misc_feature (307)..(307): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccncaggcctccgagggaggggctggaggtgggtggccaggcgtgaagcagtgagtgggaggtgaacggaagtactagtcggcgggtactcgtaggtagggaaacggggcccgtaattcccaaccctaaccgtttacccgaaaggaacgaaacccaaaacttactaacgaaaaacgtaacctaactaaaagttacgttaacttaccctaaacccttaaaaagtcgggaacgtaaccaacgtcccggtaacaaaccgaacgtaccccggggaaacggggaaccgtacccgggggtacccgtttaaggtttaacccgtttaaacggtttacgggtacggttacccgggggaaaacgggttttacggtttttccgggtttaaagggggtttacgttttcgggttttacggttccggtttacgacccgttaccggtaccg

SEQ ID NO: 302400 - DNA, 513 bp, Homo sapiens
  misc_feature: GZ8MTXP02F0CGO.52.78.H01.1.454.CMB.2.raw
  modified_base (305)..(305): a, c, t, g, unknown or other
  misc_feature (305)..(305): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggttattggtaccagcagagcaggccaggcccctatgtgatatataagacatgagaggcctnagggatccctgagcgattcctctgctcctcctcagggacaacagtcacgttgatcatcagtgagtcggcagagcgaggctgactattactgtacaatcaacagacagtagtagtagttatgtgcgagttacggcggagggacgaaacgacgtacgtaccgtccgtacggtaacgacgaccgaacggacgtacgtccccgtccgtcccg

SEQ ID NO: 302401 - DNA, 529 bp, Homo sapiens
  misc_feature: GZ8MTXP02IZNBJ.52.78.H01.1.454.CMB.2.raw
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagcgcagtacgacacgaccggtgctcgatttagtgtgagtagttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggcaggcccctatgtgatatataagaccatgagaggccctcagggatccctgagcgattctctggctcctctcgagggcaacagtcacgttnancatnagtgacgcgganagaggagagctagactattacngtacaatacaaanagaagaagtagtagtagttagttgtagtagtaggtacggtacgggacggaacgaacgtacgtacgtaccgtaccgtacggtaacgacgaccgacggaccgtccgtcccgtaccgtccg

SEQ ID NO: 302402 - DNA, 516 bp, Homo sapiens
  misc_feature: GZ8MTXP02GRQZ6.52.78.H01.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacgctcggtgtcagtgtcctcaggacagacggccaggatcacctgctctggagatgcactgccaaagcaatatggttatggtacagcagagcagcaggcccctatgnatatanaagacatgagagccctcagggatccctgagcgattctctggctcctcctcagggacaacagtcacgttgatcatcagtgagtccgggcagaggagaggctgactattactgtacaatcaaacagaacagtagtggtaacttagtgtgactaggttcgggaggacgggaaccaaaggctacggaaccgtaccgtaaggtacacggacccaaggcctccggcccccgttccgg

SEQ ID NO: 302403 - DNA, 503 bp, Homo sapiens
  misc_feature: GZ8MTXP02HO30V.52.78.H01.1.454.CMB.2.raw
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccccttatggtgatatataaggaccatgagaggccctcagggatccctgagcgatctctggctcctctcagggacaacngtcacgttgatcatcagtgagtccggcaggaggacgaggctagactatactgtacaatcaacagacagtagtggtactatgtgcagttcggcggacgggacaagctaggacctcgaagtcacgccaaggctcgcccctcggtcacttcccg

SEQ ID NO: 302404 - DNA, 552 bp, Homo sapiens
  misc_feature: GZ8MTXP02IO4JH.52.78.H01.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagcccaccctcggtgtcagtcgtcctcaggacaggacggccaggatcacctgctctgganatgcactgaccaaagcaatntggttattggtaccagnagaggccaggccaggcccccttattggtgatatataaggaccatgagaggccctagaggggactccctagagccgtattctctcggcctcctcctcgacggacaacngtcacgtgatccatcagtgaggtccggcagaggacgaggctgactattangtacaatcaacgagacagtagtggtacttagtgtacgngtaaggttcggacgggtacggaaccgtaaggccgtaggacccgtacgtacggtaccgacgccgaacgggctccgacccctcggtccaactttcccg

SEQ ID NO: 302405 - DNA, 540 bp, Homo sapiens
  misc_feature: GZ8MTXP02FMAK5.52.78.H01.1.454.CMB.2.raw
  modified_base (312)..(312): a, c, t, g, unknown or other
  misc_feature (312)..(312): n is a, c, g, or t
  modified_base (457)..(457): a, c, t, g, unknown or other
  misc_feature (457)..(457): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccctatgtgatatataaggaccatgagaggccctnagggatcccctagagcgattcctctggcctcctcctcgacgggaccaaacgagtcacgttgatacatcagtggagtcgggcagaggacgaggctagactattacgtgactaatcaacaggaacagtagtggttaacttatgtacncgtaaggttcggcggaggggacccaaaggtcgtacggacccgtcgtaggcgacgacccgaaggcctacggccccctggtaccc

SEQ ID NO: 302406 - DNA, 512 bp, Homo sapiens
  misc_feature: GZ8MTXP02FQ2AB.52.78.H01.1.454.CMB.2.raw
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctnagggatccctgagcgattctctcggctcctctcagggacaacngtcacgttgatcatcagtgagtccggcagaggacgaggctgactatactgtnaatcaacagacagtagtggtacttagtgtgctaggttcggcggacgggccaaagctagaccgtcgtacgtcagcccaaggctcggcccctcggccacgttcccg

SEQ ID NO: 302407 - DNA, 515 bp, Homo sapiens
  misc_feature: GZ8MTXP02H7OLF.52.78.H01.1.454.CMB.2.raw
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagcaaatatggttaatggtaccagcagagccaggccaggccccctatggtgatatataaggaccatgagaggccctcagggatccctgagcgatctctggctcctctcaggggacaacngtcacgttacgatcatcagtgagtcggcagaggacgaggctgactattactgtacaatccaanagacagtanggtactatgtcgnagttcgggacgagggaccaaaggctagaccgtcctagggtcacgcccgaaggctcgcccccgttcggctacgtcc

SEQ ID NO: 302408 - DNA, 518 bp, Homo sapiens
  misc_feature: GZ8MTXP02F1KSZ.52.78.H01.1.454.CMB.2.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (402)..(402): a, c, t, g, unknown or other
  misc_feature (402)..(402): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgtattggtacagcagagcagcagcccctatgtgatanataagacatganagcctgaggatccctgagcgtatccctctggctcctctcgacgggacaacagtcacgttgatcatcagtgagtcggcagaggacgtagctgactatactgtacaatnaacagaacagtagtacgttatagtgtgctaggttcggaggagggaccgaaagcgtacgtaaccgtcgttacggaacgacggacccgaaacggccgtaccgcccccgttcggtaccc

SEQ ID NO: 302409 - DNA, 520 bp, Homo sapiens
  misc_feature: GZ8MTXP02H4EEH.52.78.H01.1.454.CMB.2.raw
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcagcaggcccctatgnatatataagacatgagaggcctgaggatccctgagcgtattctctcggctccctctcgaggacaacngtcacgttgatcanacagtgagtccgggacaggaggacgaggctgactattacngtacaaatcaaacagaacagtagtagttactagtgngcgagttcggacggacggaccaagcttcgaccgttaccgaggtcacgaacccgaaggcctccgccccgtcggtacctaccgttcccg

SEQ ID NO: 302410 - DNA, 589 bp, Homo sapiens
  misc_feature: GZ8MTXP02JDAQ0.52.78.H01.1.454.CMB.2.raw
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatcggtgatatataaggaccatgagaggcctcagggatcccctgagcgattcctctggctcctctcgagggtcaacgagtcacgttgatcatcagtgagtcggcagagacgaggctgactattactgtacaatacaacagaacagtagtggttaacttagtgtagtacgacggtttacgggacgggttaacggggaccgaaaaggtccgtacggtaaccccgttaccgtaacggggttaaccgaaccgggttaaccccgaaaacggggtccgttaccggtacccccccgttcggggtttaacccccg

SEQ ID NO: 302411 - DNA, 494 bp, Homo sapiens
  misc_feature: GZ8MTXP02FWJ49.52.78.H01.1.454.CMB.2.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
tcagcgcagtacgacacgaccggtgctcgatttagtgtgagtagtttgggtttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatgtattggtacagcagagcaggcaggcccctatgtgatatataaggaccatgagaggccctnagggatccctgagcgattcctctgctcctctcagggacaacagtcacgttgatcatcagtgagtcggnagaggacgagctgactagttactgtcaatcaacagacagtagnggtactagtgtagcagttcggcggagggaccaaagctacgaccgtcctaggtcagcccaaggctcgccccctggtaccc

SEQ ID NO: 302412 - DNA, 519 bp, Homo sapiens
  misc_feature: GZ8MTXP02FNEPS.52.78.H01.1.454.CMB.2.raw
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggccccttatggtgatatataaggaccatgagaggccctcgagggatccctgagcgattcctctggctcctcctcagggcaacagtcacgttgatcatcagtggagtccgggnagaggacgaggctgactatacngtcaatcaacaganagtagtaggtagttatagtgngagttcggcggagggacgaagacgtacgaccgtccgtacggtcgacgaccgaacggcgtcgccccgtccggtcccg

SEQ ID NO: 302413 - DNA, 513 bp, Homo sapiens
  misc_feature: GZ8MTXP02GVG0D.52.78.H01.1.454.CMB.2.raw
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccctatggtgatatataaggaccatgagaggccctcaggggatcccctgagcgattcctctggctcctcctcagggcaacagtcacgttgatcatcagtggagtcgggcagaggacgaggctgactagttactgtacaatcaanagacagngtagtacttatgtgcagttcggcggaggacaagcgtacgacccgtcgtaggtcacgtacccgaagccgtacgcccccgtcggtaccc

SEQ ID NO: 302414 - DNA, 584 bp, Homo sapiens
  misc_feature: GZ8MTXP02G4ZK2.52.78.H01.1.454.CMB.2.raw
  modified_base (467)..(467): a, c, t, g, unknown or other
  misc_feature (467)..(467): n is a, c, g, or t
  modified_base (552)..(552): a, c, t, g, unknown or other
  misc_feature (552)..(552): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggaggtcgtgggggagggcgttggtccgaggccgtgggggtcccgtcgacactctcctgtgtagcctctggattcacctttaacagttattggatgtacgttgggtccgccaggctccgaggggaaggggctggagtggggtggccagcgtgaagcatgagtgggaggtgaaggagactagtgcggatctgtgaaggccgtattcaccacttccagaacgacaaacatacaaagaaactacaatgtactctacctaaaangacgacacgctagacgacgaccggaacgaccgaccggtcgttagttactacgtgtaggtacgtacgttagtttaggttaaggttnttcggtttacggtcgttacgaccgtacgtacg

SEQ ID NO: 302415 - DNA, 506 bp, Homo sapiens
  misc_feature: GZ8MTXP02HNQ40.52.78.H01.1.454.CMB.2.raw
  modified_base (424)..(424): a, c, t, g, unknown or other
  misc_feature (424)..(424): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaaggaccatgagaggcctccagggatccctgagcgattctctggctcctcctcgagggacaacagtcacgttgatcatcagtgagtcggcagagcgaggctgactatacngtcaatcaacagacagtacgtaggtattaagtgtgcgtaggttcggcgggaagggaccaagctagaccgtccttaagggccg

SEQ ID NO: 302416 - DNA, 587 bp, Homo sapiens
  misc_feature: GZ8MTXP02H284F.52.78.H01.1.454.CMB.2.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttatggtacagcagagcaggccaggcccctatggtnatatataaggaccatgagaggccctgaggactccctagagacgattctcgtcggcctcctcctcgagggacaacngtctacgttgatactancgagtgagtccggcaggagggacgaggctgaacgtattacgtcgtacaaagtcaaacagaactagtaagtagttacttagtgtagaccgtagggttaccggacgggtacgggaaccgtaaacggtcgtacggtacccggttaccgtacgggtaccaaccggaacccgaagggcccgttaccgacccccgtttccgggtcccttaaccgttcccg

SEQ ID NO: 302417 - DNA, 506 bp, Homo sapiens
  misc_feature: GZ8MTXP02INF1K.52.78.H01.1.454.CMB.2.raw
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggcccccttatggngatatataaggaccatgagaggccctcagggactccctgagcgatctctggctcctcctcgagggacaaacagtacacgttgatcatcagtggagtccgggacagaggacgaggctgactatactgtacataacanacganagtagtggtacttatgtgactagttcggnggaaggacaacgctagaccgtcgtaacggtccg

SEQ ID NO: 302418 - DNA, 518 bp, Homo sapiens
  misc_feature: GZ8MTXP02GVY6F.52.78.H01.1.454.CMB.2.raw
  modified_base (221)..(221): a, c, t, g, unknown or other
  misc_feature (221)..(221): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagaggccaggccaggcccccttatggtgatatataaggaccatgagaggccctcagggatccctgagcgattctctcggctcctctcagggacaacngtcacgttgatcatcagtgagtccggnagaggacgaggctgactattactgtacaatcaacagacagtagtggtacttatgtgctaggttcggacggacgggaccaagcgtagaccgtcctaggtcaggcccgaaggcctacgccccctcggtccacgttcccg

SEQ ID NO: 302419 - DNA, 546 bp, Homo sapiens
  misc_feature: GZ8MTXP02HJS1N.52.78.H01.1.454.CMB.2.raw
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaatatggtatggtacngcagagcagcaggcccctatgngatatataaggaccatgagaggccctcgagggactccctagagcgtattctctcggcctcctcctcgaggacaacncgtcacgttgatcatcagtgagtccgggacaggaggagaggctaggacttattacgtgtacaatcaacagactagtagtcggtaattagngtgctaggttcggacggtacggaccgagtacgtacggaccgtacgtacggtaccgacgaacccgaaaggtcctaccggcccccgttcgggtcctaacgtttcccgg

SEQ ID NO: 302420 - DNA, 698 bp, Homo sapiens
  misc_feature: GZ8MTXP02H8IDS.52.78.H01.1.454.CMB.2.raw
  modified_base (284)..(284): a, c, t, g, unknown or other
  misc_feature (284)..(284): n is a, c, g, or t
  modified_base (549)..(549): a, c, t, g, unknown or other
  misc_feature (549)..(549): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctcgtgggcctcctatgaactgaacacacgcccacccgtcggtgtccagtcgtcctacgaggacacggaccggcaggactcaactgctcgtaggagatgcacncgaccaaagactaatagttggttagttcgtaaccagaccaaggacggaccgacggcccgaccggtaccccctttagttcgggtagtaataagtagtaaaaggacctagtacgaacgaccggtccccaagaaacgggtactccccgtgacggtctaagtttcctcgtcgggtccttcccgtccctaggaaacgggtaaccaaacgtaacgtacgtaacggtttgaacttaccaagttccgaaaggtacgggttcggtacccggggngtaaagggagggaccgggaagtccgtaaggaactttaagtaccgttagtacctaaagtacccgaaaacgacgtagtaacgttaggtacgttaacttagtacgtacgtaacggtacggtacgggacgggtaacgtacgtacgtaccgtcg

SEQ ID NO: 302421 - DNA, 494 bp, Homo sapiens
  misc_feature: GZ8MTXP02IYDZI.52.78.H01.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (425)..(425): a, c, t, g, unknown or other
  misc_feature (425)..(425): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagcagcaggcccctatgnatatataaggacatgagaggcctnagggatccctgagcgtatctctggctcctctcagggacaacngtcacgttgatcatcagtgagtcgggcaggagacgaggctagactatactgtacaatcaacagacagtagtagtactatgtncgtaggtcggcggaacggaccaaagctagaaccgtcctagcacgccgaaggctcgccctcggcactccg

SEQ ID NO: 302422 - DNA, 510 bp, Homo sapiens
  misc_feature: GZ8MTXP02GIU8O.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatgtatgtacagcagagcaggccaggcccctatggtgatatataaggaccatgagaggccctcagggatccctgagcgtatcctctggctcctcctcgagggacaacagtacacgttgatcatcagtgagtcggcagaggacgagcgtgactatactgtcaatacaacagacagtagtgtactatgtgcgtagttcggcggaagggaccaaagtcgtacgacccgtcgtagtcgacgaccgaaacggcctcgcccccgtcggtaccc

SEQ ID NO: 302423 - DNA, 501 bp, Homo sapiens
  misc_feature: GZ8MTXP02H45AV.52.78.H01.1.454.CMB.2.raw
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
  modified_base (496)..(496): a, c, t, g, unknown or other
  misc_feature (496)..(496): n is a, c, g, or t
tcagcgcagtacgacacgaccggtgctcgatttagtgtgagtagtttgggtttggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccaggcccccttatggtgatanataaggaccatgagaggcctcagggatccctgagcgattctctggctcctcctcaggggacacngtcacgttgatcatcagtggatccgggcaggagacgaggctgactatactgtcaatcaacagacagtagtgtacttatgtgctagttcggcggaggggacaagcgtagaccgtcgtagtcacgccaaggctcgcccctcggtcncgtcc

SEQ ID NO: 302424 - DNA, 558 bp, Homo sapiens
  misc_feature: GZ8MTXP02GO6ZP.52.78.H01.1.454.CMB.2.raw
  modified_base (225)..(225): a, c, t, g, unknown or other
  misc_feature (225)..(225): n is a, c, g, or t
  modified_base (469)..(469): a, c, t, g, unknown or other
  misc_feature (469)..(469): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtaccagcagaggccaggccaggccccttagtggtgatatataaggaccatgagacggccctcgagggactcccgtagagcgattcctcgtggcctcctcctcgaggggacaacacgtacaccgttgactcatcagtggagtccgggacaggacggacgaggctagactattaactgtacaatcaacagaacagtagtaggtaacttagtgtagngtaggttcggacgggtagggaaccaaaggccgtacgaccgtcgtacggcgtacgacccgtaacggccgtccggtcccccgtcggtaccc

SEQ ID NO: 302425 - DNA, 508 bp, Homo sapiens
  misc_feature: GZ8MTXP02INZZ6.52.78.H01.1.454.CMB.2.raw
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggccccttatggtgatatataaggaccatgagaggcctcgagggatccctgagcgattctctggcctcctcctcagggacaacngtcacgttgatcatcagtggagtccggnaggngacgaggctgactatactgtacaatacaacagacaggtagtggtacttatgtgctagtcggcgggaggaccaagctagaccgtccgtagtcacgccgaaggctcgcccctcggtcacgttc

SEQ ID NO: 302426 - DNA, 590 bp, Homo sapiens
  misc_feature: GZ8MTXP02GHT3A.52.78.H01.1.454.CMB.2.raw
  modified_base (395)..(395): a, c, t, g, unknown or other
  misc_feature (395)..(395): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatgttatgtaccagcagagccaggccaggccccttatggtgatatataaggacatgagaggccctcgaggactccctgagcgtattccctcgtcggctccctcctaccgagggaccaacacgtacacgttgaatcatcagtggagtccggganagaggacggaggctagactattacgtgtacaactacaaacagaactagtaggttaggtaatttaagtgtagtacgtaggttacggggacgggacggggaaccgaaacggccgttaccggacccggttacccgttaggtaaccgaaccggaccccgaaacggggtccctacccggtacccccgtcggttaaccccg

SEQ ID NO: 302427 - DNA, 538 bp, Homo sapiens
  misc_feature: GZ8MTXP02GHYG0.52.78.H01.1.454.CMB.2.raw
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctnagggatccctgagcgattctctggctcctcctcagggaccaacngtcacgttgatcatcagtgagtccggcagaggacgnggctgacttatacgtgtacaatcaacagacaggtagtaggtacttaatcggtgcgtaggttcgggaggaacggggacctaaggcgtacgaccgtccgtaggtccgacgaacccgaaggcctccgcccccgtcggtacaccttccg

SEQ ID NO: 302428 - DNA, 522 bp, Homo sapiens
  misc_feature: GZ8MTXP02GSQUK.52.78.H01.1.454.CMB.2.raw
  modified_base (307)..(307): a, c, t, g, unknown or other
  misc_feature (307)..(307): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccnccaggctccgaggggagggctggagtgggtgccaggcgtgaagcatgatgggagtgaggaagactatggcgactcgtgtgaagggccgattccacctacttccaagagaacaacatacaaagaactcaatagtatcctacaaatgagcagctgacatcgagacacggtctgtactacgtgcgacgagtagttgtggattgttgtcgtnctacncg

SEQ ID NO: 302429 - DNA, 579 bp, Homo sapiens
  misc_feature: GZ8MTXP02F73J5.52.78.H01.1.454.CMB.2.raw
  modified_base (395)..(395): a, c, t, g, unknown or other
  misc_feature (395)..(395): n is a, c, g, or t
  modified_base (454)..(454): a, c, t, g, unknown or other
  misc_feature (454)..(454): n is a, c, g, or t
tcagcgcagtacgacacgaccggtgctcgatttagtgtgagtagttgggtttgggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaaatatggttattggtacagcagagcaggccaggccccttatggtgatatataaggaccatgagaggccctgagggactcccgtgagcgtattcctctcggctcctcctcgacggggacaacgagtcaacgttgatcatcgagtggagtccggganacggaggacgaggctgactattactgtacaatacaacagacaggtagtaggtacttagngtgtcgtaggttcgggacgggaagggacccaaaggtccgtacggtaacccggtccgtttaaaggggcccgaacggaccccgaaacggggtccctacccggggtccccccgttacgggttcccccg

SEQ ID NO: 302430 - DNA, 570 bp, Homo sapiens
  misc_feature: GZ8MTXP02J1NQW.52.78.H01.1.454.CMB.2.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagccaggccaggcccctatggtgatatataaggaccatgagaggccctnagggatccctgagcgattctctcggcctcctcctcgagggaccaacngtcacgttgatcgatcagtggacgtccggcaggaggacgaggctggactattactgtacaatcaanagacagtagtgtacttagngtgactaggttcggacggacgggaccgaaaggccgttacggacccgttaccgtaacgggttccgaacggtccccgaaaacggggtcccgtacccggtaccccccgttcgggtaccctacccgtttccccgg

SEQ ID NO: 302431 - DNA, 545 bp, Homo sapiens
  misc_feature: GZ8MTXP02HML9U.52.78.H01.1.454.CMB.2.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttattcggtgatatataaggaccatgagaggccctnagggatccctgagcgattcctctggctcctctcagggacaacagtcacgttgatcatcagtggagtccgggcagaggacgagctagactattacngtanaagtnaacagacagtagtggtacttagtgttgataggttcggacgggacgggaacccaaaggtcgtacggacccgtacgttagggccaacggacccgaaaggcccgtaccgcccccgttacgggtccc

SEQ ID NO: 302432 - DNA, 520 bp, Homo sapiens
  misc_feature: GZ8MTXP02H7AFN.52.78.H01.1.454.CMB.2.raw
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctnaggacagacggccaggatcacctgctctggagatgcactgaccaaagcaatatggttatggtaccagcagngcaggccagccccttatgtgatatataaggacatgagacgcctcgagggactccctgagctattctctcggctcccnccctgacggacaacgagctacgttagactcatcgagtggacgtccgggcagaggacgaggctagactagtactgataactacaaacagacagtagtaggtactagtgtgaacgtgtacggcggacgggaccaagtcacgg

SEQ ID NO: 302433 - DNA, 531 bp, Homo sapiens
  misc_feature: GZ8MTXP02GZX7I.52.78.H01.1.454.CMB.2.raw
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagccaggccaggcccccttatggtgatatataaggaccatgagaggccctgagggatccctgagcgatctctggctcctctcgaggacaacngtcacgttgatcatcaggtgagtccgggnaggaggacgaggctgacgtatactgtacagtcaacagacgagtagtagtacttagtgtgcgaggttcggcgggtacgggaccaaagccttaggaacccgttcgtacggtacacggcccgaaaggcctacggcccccgtacggtccacttcccg

SEQ ID NO: 302434 - DNA, 527 bp, Homo sapiens
  misc_feature: GZ8MTXP02FR338.52.78.H01.1.454.CMB.2.raw
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaagcaatatggttatggtaccagcagagccagccaggcccctatggngatatataaggaccatgagacggcctcgagggatccctgagcgattctcnggctcctcctcaggaacaacagtcacgttanatnatnagtgacgcggngaggaggacgagctagacttattacgtagtacaatacaacgagacgtagtagtagttaattagtgtacgtacgtacggtcgggacggaacgggaccgaacggtcgtacggtaccgtaccgtacggtaccg

SEQ ID NO: 302435 - DNA, 502 bp, Homo sapiens
  misc_feature: GZ8MTXP02I3AGF.52.78.H01.1.454.CMB.2.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagngcaggccaggcccctatgngatanataaggcatgagaggccctnagggatccctgagcgattctctcggctcctctcagggaccaacngtcacgttgatcatcagtgagtcggcagaggacgagctgactagtacngtacaatcaacagacagtagtggtacttatgtagctagttcggcggagggaccaagcgtagaccgtcgtaacggtcagccgaacggctcgcccctcggtcacttccg

SEQ ID NO: 302436 - DNA, 606 bp, Homo sapiens
  misc_feature: GZ8MTXP02JXIV6.52.78.H01.1.454.CMB.2.raw
  modified_base (374)..(374): a, c, t, g, unknown or other
  misc_feature (374)..(374): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttatggtaccagcagaggccaggccacggcccccttagttcggtgatataataaggaccatgagacggccctgacgggactccctgacgcgtagttctcgtcggcctcctcctacgacgggtaacaacgngtacctacgtttagactacacttccgagggtacggggtacggtcccggggacgaagggaagggacggaggcgtagtaacgttaacttacgtagtacaaattaccaaacagaacctaaggttagtaggttacttagtgtagcgtaggttcgggacggtacgggacaggcgtacggaccgtacgtacggtccgacgaacccgaagccgtccgtccccgtcggtcaccgtttccg

SEQ ID NO: 302437 - DNA, 488 bp, Homo sapiens
  misc_feature: GZ8MTXP02JK951.52.78.H01.1.454.CMB.2.raw
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggccaggccccctatgngatatataaggaccatgagaggccctcagggatccctgagcgattcctctggctcctcctcagggacaacagtcacgttgatcatcagtggagtcggcagagcgagctgactattacngtacatcaanagacagtagtggtactatgtgcagttcggnggaggaccagcncgacgtctagcgacgaccagctcgcccctggtcc

SEQ ID NO: 302438 - DNA, 606 bp, Homo sapiens
  misc_feature: GZ8MTXP02GCONR.52.78.H01.1.454.CMB.2.raw
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatgttattggtacagcagagcaggccacggccccttatggtgatatataaggaccatgagaggccctgagggactcccgtgagcgtattccgtctggcctcctcctcgagggaccaaacgagtacaccgttgactacataccaggttacggacggtccgggcaagggacgggaccggaggtcctagaaccttattaaccgtgtaccaatacaaagagaccgtaagttaggtaggttacttatggtagacgtaggtttccggggacggacggggaaacccgtaaggccgttacggaacccggttcgtaacgggtcgaaccggacccgaaacgggtccttacccggcccccgtttacgggtacccc

SEQ ID NO: 302439 - DNA, 527 bp, Homo sapiens
  misc_feature: GZ8MTXP02FQS0R.52.78.H01.1.454.CMB.2.raw
  modified_base (358)..(358): a, c, t, g, unknown or other
  misc_feature (358)..(358): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcgagggatccctgacgcgattctctggcctcctcctcaggacaacngtcacgttgatcatcagtgagtccggcaggaggacgaggctgactatactgtacaatacaacagacaggtagtacggtattagtagttgctaaggttcggcgggacgggaccaagcgtcgaaccgtcgtacggcacgccgaaggctccgccccgtcggtccactttccg

SEQ ID NO: 302440 - DNA, 588 bp, Homo sapiens
  misc_feature: GZ8MTXP02G7ZPA.52.78.H01.1.454.CMB.2.raw
  modified_base (305)..(305): a, c, t, g, unknown or other
  misc_feature (305)..(305): n is a, c, g, or t
  modified_base (538)..(538): a, c, t, g, unknown or other
  misc_feature (538)..(538): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtggggggtccctgacactctcctgtgtagcctctggattcacctttaacagttatggatgacttgggccnccaggctcgagggaggctggagtgggtgccagcgtgaagcagtgagtggaggtgaaggaagtactaagtggacgggacttcgtagtagggaaacggggtccgtaatttcccaacccgtacttacccaaggaacgaacaaacataccgaaaagaaacctcaaattgtaacttcaaccaaaagtgaacgacacgccctagacacgtcccggaagaccacggtctaggtattacgngtagacgagttacgtttgttggattggttcgttacggtcacctaccgacg

SEQ ID NO: 302441 - DNA, 583 bp, Homo sapiens
  misc_feature: GZ8MTXP02IA9CI.52.78.H01.1.454.CMB.2.raw
  modified_base (482)..(482): a, c, t, g, unknown or other
  misc_feature (482)..(482): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggaggcttggtccagccgtggggggtccctgacactctcctgtgtagcctctggattcacctttaacagttattggatgtacttgggtccgccaggcctccgaggggaaggggctgggagtggggtggccaggcgtgaaagcatggatgggaggtgaagggaagactaagtggacggacttcgtggtaggaacggggcctattccaccacttcccagacgaacaacatacaaagaactacaatagtactctacctaaaatgancacgcctagacacgtccggaagaccgacggccgtagttactttaactgtacgcgagttacgtttcgtttaagggattcggtttgtcgtttcgctaaccgcg

SEQ ID NO: 302442 - DNA, 561 bp, Homo sapiens
  misc_feature: GZ8MTXP02JYRRL.52.78.H01.1.454.CMB.2.raw
  modified_base (307)..(307): a, c, t, g, unknown or other
  misc_feature (307)..(307): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccnccaggctccgagggagggctggagtgggtgccagcgtgaagcatgatggaggtgaaggaagactagtggcggtactcgtgtaggaaacggggccgaattccaaccctacttcccgaagacgaacaacatcaaagactacaatgtaatctaccaaatgaagcagcctggacagtacccgagacacgggccgtagtattacgtgtcggacgagtacgtttcgttggggatttggttgtacgttcgccaacccgtgg

SEQ ID NO: 302443 - DNA, 600 bp, Homo sapiens
  misc_feature: GZ8MTXP02J3Q6S.52.78.H01.1.454.CMB.2.raw
  modified_base (364)..(364): a, c, t, g, unknown or other
  misc_feature (364)..(364): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaattatggttattggtaccagcagaggccaggcccaggcccccttattcggtgatatataaggaccatgagaggccctacgagggatcccgtgagcgattctctcggctcctcctcagggacaacgngtcacgttgattcatcaggtgacggtccgggacaggagggacgaggggcctaggacttaactttactacgtacaaatacaaacgtagaaccaagggttaggtagggttaacctttaagtcggtggtacgtaggtttaccggggacggtaacggggacccaaaggcgtacgaccgtccgtacgggtaccacggcccgaacggccgtccggacccccgttcggtacctacgtttcccg

SEQ ID NO: 302444 - DNA, 627 bp, Homo sapiens
  misc_feature: GZ8MTXP02ISZIW.52.78.H01.1.454.CMB.2.raw
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttattcggtgatatataaggaccatgagaggccctagagggactcccgtgacgcgtattctctcggctccctctcgaggaccaacgngtcacgttgatcatcgacgtgggacgtcccgggngaaggaggaccggaggtccgtagtacgttattaacgtgtactaaactacgaaacgaagtacgaaggttacggtagttaacgtttagtaggtcggacgttaacggggtttcggggaacggggtacggggaacccgtaaagtccggtacggtaacccggtccgttacgggtaccaccgtaacccgaaggccgtacccggtccccgtacggttacctaccgtttccccg

SEQ ID NO: 302445 - DNA, 583 bp, Homo sapiens
  misc_feature: GZ8MTXP02I2W92.52.78.H01.1.454.CMB.2.raw
  modified_base (352)..(352): a, c, t, g, unknown or other
  misc_feature (352)..(352): n is a, c, g, or t
  modified_base (437)..(437): a, c, t, g, unknown or other
  misc_feature (437)..(437): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagccgtggggggtccctgacactctcctgtgtagcctctggattcacctttaacagttattggatgacttgggtccgccaggctccgaggggaggggctggagtgggtggccagcgtgaagnatgatggagtgaggaagactatgcggactcgtgtggaagggccgattccacctacttccaagacgaacaacatacaaagaactanaatgtactactaacaaatgagacacgcctagaactacgaccggaaggaccgaccggggtccgttagttacgttacgtggcggtacgtacgttacggttttacggttaagggtatttcggtttacggtcgtttcgaccgtaccgtag

SEQ ID NO: 302446 - DNA, 595 bp, Homo sapiens
  misc_feature: GZ8MTXP02F5NQ3.52.78.H01.1.454.CMB.2.raw
  modified_base (294)..(294): a, c, t, g, unknown or other
  misc_feature (294)..(294): n is a, c, g, or t
tcagcgcagtacgacacgaccggtgctcgatttagtgtgagtagtttggggtttggggctggggagcctagctgtgctgtgggtccaggaggcagaactctgggtgtctcaccatggcctggatccctctacttctcccctctcactctctgcacaggctctgggcctctatgaactgacacagccaccctcggtgtcagtgtcctcaggacagaccggccaggactcacctgctcgtggagatgcactgccaaagcaatatgtatgtaccagcagagcagcacgccctagtgngatatataaggcatgagacggcctagaggactcccgtgacgtcgattcgtcgcggtcctccgtcctagacgggaccaaacgtgtaccctagttacattaccgaatccgtaaggttcggtacggtaacccggggagtaacggaacggacggttacggtacgtacgtaacgtacgttacgtacgtacgtaacgtaacgtaacgtaacgtacgtaagtacggttagttagttacgtacgtacgtacgtacggtacggtacggtaacggtacgtacgtacgtaccgtaccgtaccgtacggtacg

SEQ ID NO: 302447 - DNA, 552 bp, Homo sapiens
  misc_feature: GZ8MTXP02HS25U.52.78.H01.1.454.CMB.2.raw
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagccaggccacggccccttattcggngatatataagaccatgagacggcctcgagggactcccgtgacgcgtattcgtccgtcggtcctccctcctacgagggaccaacncgtcacgttgactcatcagngagtccggnaggaggacgagctagactatacgtgtacactacaanagactagtagtaggtacttagtgtgcgtagtcgggacggacgggaccaaggctacggtaccgtacgtacggtcgacgaacccgaaggccttccgcccgttacggtctaccgttcccg

SEQ ID NO: 302448 - DNA, 537 bp, Homo sapiens
  misc_feature: GZ8MTXP02ISLN6.52.78.H01.1.454.CMB.2.raw
  modified_base (435)..(435): a, c, t, g, unknown or other
  misc_feature (435)..(435): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagtcggtagatatataaggaccatgagaggccctgagggatccctgagcgacttcctcgtgctcctcctcgacgggacaacgagtcacgttgactcatcagtggacgtcggacagaggacgagcgtagactattactgtaccaattcaanagacagtgtaggtatagtgtagcgtaggttcggacggacggacgaaagcgtacgaccgtccgtagtccgacgacccaacggccgccgtccccgtacggtccc

SEQ ID NO: 302449 - DNA, 546 bp, Homo sapiens
  misc_feature: GZ8MTXP02H8MD7.52.78.H01.1.454.CMB.2.raw
  modified_base (302)..(302): a, c, t, g, unknown or other
  misc_feature (302)..(302): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaagcaatatggttatggtaccagcagacgcaggccacgtcccctatggnatatataaggcatgagacgcctcgagggactcctgagcgattctcgtggccttcctcctcgacgggtacaacgagtctacgttgatcgatcgagtggacgtcgggcaggacggacggaggtctaggacttagttacgtgtacaataccgaagagacgaggttagtcggttaacttagtggagtaccgtaggttcgggacggaacgggaccaaaggtccgtacggaaccgttccgttacggaccg

SEQ ID NO: 302450 - DNA, 529 bp, Homo sapiens
  misc_feature: GZ8MTXP02JT0XV.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgcccaaagcaatatggttattggtaccagcagaggccaggccacggcccccttatggtgatatataaggaccatgagacggcctcgaggatccctgacgcgattcctctggtcctcctcctcgagggaccaacgagtcacgttgatcatcgaagtggacgtccgggacaggaggacgaggctaggacttatactgtacaatacaacagacagtagtaggtactagtgtagacgtaggttcggaggaacggacgaacgtcgtacgaccgtacgtaggaccg

SEQ ID NO: 302451 - DNA, 547 bp, Homo sapiens
  misc_feature: GZ8MTXP02GAFN3.52.78.H01.1.454.CMB.2.raw
  modified_base (310)..(310): a, c, t, g, unknown or other
  misc_feature (310)..(310): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccagccccttatggtgatatataaggacatgagaggcctnaggatccctgagcgattcctctgctccgtctcagggacaacagtcacgttgatcatcagtggagtccgggcaggagacgaggctgactattactgtacaatcaaacagaacaagtagtggtaacttaagtgtagactaggttacggacggaaacggggaccaaagcgtacggtaaccgtaccgtaacggtaacgacggacccgaaacgggccttaccggccccccgttaggtacccg

SEQ ID NO: 302452 - DNA, 545 bp, Homo sapiens
  misc_feature: GZ8MTXP02H1NJL.52.78.H01.1.454.CMB.2.raw
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggccccctatggtgatatataaggaccatgagaggccctcagggatccctgagcgattcnctggctcctctcagggacaacngtcagttgatcatcagtgagtccgggcagaggcgaggctgactattacngtacaatcaanagacaggtagtggtaacttagtgtgcgtagttcgggacggacgggaaccgaaagcttacggaccgtaccgtaacggttcgaacgcccgaaaggccgttaccggcccccgttaccgggtaccaccgtttcccg

SEQ ID NO: 302453 - DNA, 503 bp, Homo sapiens
  misc_feature: GZ8MTXP02F6A98.52.78.H01.1.454.CMB.2.raw
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctctcactctctgcacaggctctgggcctcctatgaactgacacagccaccctggtgtcagtgtcctcaggacagacggccaggatcacctgctcgtggagatgcactgccaaagcaatatgtatggtaccagcagngcagcagccctatgngntanatagacatgagagcctcgaggctccngagcgattcgctggctcctctcgagggacaacngtcacgttanatnatgtagtgacgacgagaggacgagagngacgtactatacgtacgtactactacanagagtagtacgtagtagtacgtagtacgtacgtacgtacggacggaacggacgacgtacgtacgtaccgtacgtacgtacg

SEQ ID NO: 302454 - DNA, 503 bp, Homo sapiens
  misc_feature: GZ8MTXP02JVOLK.52.78.H01.1.454.CMB.2.raw
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (425)..(426): a, c, t, g, unknown or other
  misc_feature (425)..(426): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggtattggtaccagcagaggccaggccaggccccctatggtgatatataaggaccatgagaggcctcgagggatccctgacgccgattcctctggcctcctctcacgggacaacgagttcacgttgatcatcagtgagtccggganagagagagntgactatannacancaanagactagtacgtagtatagtgtgacgtagtcggacggaaggacaacgtacgacgtaccgtacgacgtcg

SEQ ID NO: 302455 - DNA, 577 bp, Homo sapiens
  misc_feature: GZ8MTXP02HMQCI.52.78.H01.1.454.CMB.2.raw
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (546)..(546): a, c, t, g, unknown or other
  misc_feature (546)..(546): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtagcctctggattcacctttaacagttatggatgacttgggtccnccaggctccgaggggtaaggggctggagtggggtagccagcgtgaagcagtgagtggagtgagganactagtgcgatcgtgtggaacgggctagttcacctacttaccaggacaacacgatacgaaagaactacaaatgtactactacctaaaanganacacgccacgacacgaccggacgacgaccggtacgttagttaacttcgtggtacgacgtaagttcggtttacggttaagggtntttcggttcggtacgttcgaccgtacgtacg

SEQ ID NO: 302456 - DNA, 561 bp, Homo sapiens
  misc_feature: GZ8MTXP02JWLBR.52.78.H01.1.454.CMB.2.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
  modified_base (516)..(516): a, c, t, g, unknown or other
  misc_feature (516)..(516): n is a, c, g, or t
  modified_base (560)..(560): a, c, t, g, unknown or other
  misc_feature (560)..(560): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgagcctctggattcaccttaacngttatggatgacttgggtccnccaggctccgaggggaaggggctggagtggggtggccaggcgtgaaagcatgatggaggtgaggaagactatgcggactcgtgtgaagggcccgattccaccctaacttcccgaagacgaaccaanatacaaagaactacaaatcgtatctaccaaaatgacgacaagccctaggaacacgtccgaaggtacacgggccgttagattacgngtcgacgtagtcgtttgttggtattcggttcgtcgtcgacacgng

SEQ ID NO: 302457 - DNA, 553 bp, Homo sapiens
  misc_feature: GZ8MTXP02F841Q.52.78.H01.1.454.CMB.2.raw
  modified_base (362)..(362): a, c, t, g, unknown or other
  misc_feature (362)..(362): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatcggtgatatataaggaccatgagacggccctcgagggactcccctagagcgattctctcggctcctctcagggacaacngtcacgttgatcatcagtgagtccggcaggagacgagctgactatactgtacaatacaacagactaaggtagtacggtattagtagttgcgtaggttcggcgggaacgggacccaaaggtctacggaccgtaccgtaggtcacggaacccgaaacggccgttccggcccccgtcggtacctacgtttcccg

SEQ ID NO: 302458 - DNA, 540 bp, Homo sapiens
  misc_feature: GZ8MTXP02GXX0S.52.78.H01.1.454.CMB.2.raw
  modified_base (429)..(429): a, c, t, g, unknown or other
  misc_feature (429)..(429): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggccctacgagggatccccgtgagcgtattcctctggctcctcctcgagggacaacagtcacgttgatcatcagtggagtccgggacagaggacgagctgactattactgtacaatcaanagacagtagtaggtacttatgtgacgagttacgggcggaggggtaccaaaggctacgacccgtcgtaggtcgacgacccgaaagggcctaccggtcccccgtcggtacccg

SEQ ID NO: 302459 - DNA, 531 bp, Homo sapiens
  misc_feature: GZ8MTXP02I76VL.52.78.H01.1.454.CMB.2.raw
  modified_base (313)..(313): a, c, t, g, unknown or other
  misc_feature (313)..(313): n is a, c, g, or t
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggccctnaggggactccctgagcgattctctggcctcctcctcagggacaacngtcacgttgatcatcagtgagtccggcagaggacgaggctagactattacngtacaatacaacagacagtagtacggtattagngtagcgtagttcggcggacgggacctaaagcgtagaccgttccgacggtcacgcccgaaggcctacggccccctggtccactttcccg

SEQ ID NO: 302460 - DNA, 562 bp, Homo sapiens
  misc_feature: GZ8MTXP02IUTRO.52.78.H01.1.454.CMB.2.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
  modified_base (508)..(508): a, c, t, g, unknown or other
  misc_feature (508)..(508): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggagcttggtccagccgtggggggtccctgacactctcctgtgtagcctctggattcacctttaacagttattggatgtacttgggtccnccaggctcgagggagggctggagtgggtgccagcgtgaagnatgagtggagtgaggaanacgtagtggcggactcgtggtggaaaggggccgtattaccgacctacttccaagacgaacaaacntacaaagaactacaaagttgtactctacaaatgagacagcctagacagtccgaagacacggtctagtacttacgngtacgacgtagtagtttcgttaaggggtctttggttcgtcgtcgaccgacgtcg

SEQ ID NO: 302461 - DNA, 582 bp, Homo sapiens
  misc_feature: GZ8MTXP02FMUBB.52.78.H01.1.454.CMB.2.raw
  modified_base (309)..(309): a, c, t, g, unknown or other
  misc_feature (309)..(309): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagtttattggatgacttgggtccnccaggctccgaggggaaggggctggagtggggtgccagcgtgaagcatgatggaggtgaggaagactatgcggactcgtgtagaaggggccagttcaccctacttccaagacgaacaaacatacaaagaactacaatgtaactctaccaaagtgaagcaacgcctagactacgtcccggaaggaccgaacgggtcccgtaggttaacttacgtggtaggccgtaagtagtttcgtttggggtatttggtttcgttcggtttcgcctactacgg

SEQ ID NO: 302462 - DNA, 545 bp, Homo sapiens
  misc_feature: GZ8MTXP02IAES7.52.78.H01.1.454.CMB.2.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgccaaagcaatatgttatgtacagcagagcagcagccccttatgtgatatataaggccatgagaggccctcgagggatccctgagcgtattcctcgtggctcctcctcgacgggacaacngtacaccgtttgactcatcagtcggagtcccgggganaggaggaccggaggcgtagacttattactcgtacaatcaacagacagtagtaggtacttatgtagcgtaggttcggacggacggaccgaaagcgtcgaacccggttcgtaacggtcgacggacccgaacgggtctccggtcccccgtacggtccc

SEQ ID NO: 302463 - DNA, 661 bp, Homo sapiens
  misc_feature: GZ8MTXP02ILCG0.52.78.H01.1.454.CMB.2.raw
  modified_base (469)..(469): a, c, t, g, unknown or other
  misc_feature (469)..(469): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggaggcttggtccagccgtgggggtccctgacactctcctgtgtagcctctggattcacctttaacagtttattggatgtacgttgggtccgccaggctccgagggaggctggagtggggtgccagcgtgagcatgagtgggagtgaaggaagtactagtcggcggactcgtgtacggaacggggcctaagttccaaccgtacctttacccgaagaacggaaaccaaacacttaacaaagtaaaccctanaagttataacttacctaaccctaaaattcggaaagacccgagacccgttaggaaccgtaacgttaccggaaacgggaaacccgaaccgggtacccgtttaggtttaaacgttaaccgttggtacggaccgggtaagttacggttttacggtttggggtagtttggtttcgtacggtttcgacctaccgtacg

SEQ ID NO: 302464 - DNA, 525 bp, Homo sapiens
  misc_feature: GZ8MTXP02IYHX4.52.78.H01.1.454.CMB.2.raw
  modified_base (357)..(357): a, c, t, g, unknown or other
  misc_feature (357)..(357): n is a, c, g, or t
  modified_base (448)..(448): a, c, t, g, unknown or other
  misc_feature (448)..(448): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggccctcagggatcccgtgacgcgattctctcggctcctctcgaggacaacngtcacgttgatcatcagtggagtccgggacaggacggacgaggctgactatactgtacaatacaacagacagtagtggtacttagtgtcgntagttcggacggtacgggacaagcgtacgaccgtcaacggtcacgcccgaaggcctcgccccgtcggtcaccttccg

SEQ ID NO: 302465 - DNA, 712 bp, Homo sapiens
  misc_feature: GZ8MTXP02JJTST.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacgaccaggatcacctgctctggagatgcactgccaaagcaatatgtatgtacagcagagcagccacggcccctagtggtgatatagtaaggaccagtgagacggccctacgaggggtactccccgtaggacgcgtacttccgtcgtcgggtcccttcccgtcccgtacggaacggggaaccaaaccgtacgtacccgtacggttacgacttaccgacttaccgaaggttcgggtaacgggtccccggggagaaacgggaacggggaaacggacgggtaccgttacgggtaacctttaaacgtttaccgttacggttaacctaaaacttaccgtaaaaccgtaaggaaaccgtaacgggttaacggttaggtttaaccgtttaaaggttggttacggtaccgttaaacggggtttccggggaccggggtaaacggggtaaccccgaaaaggtccggttaccggtaacccggttacccggtaacggttaaccccgg

SEQ ID NO: 302466 - DNA, 536 bp, Homo sapiens
  misc_feature: GZ8MTXP02HLBEG.52.78.H01.1.454.CMB.2.raw
  modified_base (221)..(221): a, c, t, g, unknown or other
  misc_feature (221)..(221): n is a, c, g, or t
  modified_base (405)..(405): a, c, t, g, unknown or other
  misc_feature (405)..(405): n is a, c, g, or t
  modified_base (452)..(452): a, c, t, g, unknown or other
  misc_feature (452)..(452): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcactggctctgggcctcctatgaactgacacagccaccctcggtgtcagtgtcctcaggacagacggccaggatcacctgctctgganatgtactgaccaaagcaatatggttatggtaccagcagagccaggccaggcccccttatggtgatatataaggaccagtgagacggccctcgagggactccctgagcgattcgtctggccctcctccctcgagggacaacgacgtcacgttgactcatcgagtggacgtccggacagaggacgngctagactataactgtacaatacaacagacaaggtagtagtacttangtgcgtagttcggagggaacggacaagtcgacgaccgtcgtacggcacgcccgaagcctcgccccgtggtccacgttcctcccg

SEQ ID NO: 302467 - DNA, 541 bp, Homo sapiens
  misc_feature: GZ8MTXP02I6Q72.52.78.H01.1.454.CMB.2.raw
  modified_base (355)..(355): a, c, t, g, unknown or other
  misc_feature (355)..(355): n is a, c, g, or t
  modified_base (422)..(422): a, c, t, g, unknown or other
  misc_feature (422)..(422): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgccaaagcaatatggttattggtaccagcagaggccaggccaggcccccttatcggtgatatataaggaccatgagaggcctccgaggatcccgtgagcgattccgtntcggcctcctcctcgagggaccaacagtcacgttgatcatcagtggagtcggcagaggacgaggtcnggtactatactgtacaatactaacgagaacgagtacgtaggtacttagtgtacgtcgtaacggttcggacgggaacgggaccaaaggtccgtacggtacccgtaccgttaacggtcccg

SEQ ID NO: 302468 - DNA, 558 bp, Homo sapiens
  misc_feature: GZ8MTXP02ITUGS.52.78.H01.1.454.CMB.2.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtaccagcagaggccaggccaggccccttatggngatatataaggaccatgagacggccctgaggactccctgaagcgtattctcgtcggtcctcctctcgaggacaacngtcagtnatantnagtgagtcggacgagaggagngctagactattacagtanaatacaaagacgtanaggtagtacggtattagtgtgacgtaggttcggacgggtaacggaccgagtaccgtacggtaccgtccgtacggtaccgaccgaaccgaacgccgtacccggtccccgtccggtaccctaccgtttcccg

SEQ ID NO: 302469 - DNA, 657 bp, Homo sapiens
  misc_feature: GZ8MTXP02HGWYF.52.78.H01.1.454.CMB.2.raw
  modified_base (645)..(645): a, c, t, g, unknown or other
  misc_feature (645)..(645): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggtcccccttagttcggtgatactaataaggaccagtgagacggcctcgagggactccgtagacgcgtatctcgtccggtcctccctccgtacacggggaaccaaacgtcgtaccgtacggtttcgaactcctaatccgagggttagggaaccgggttcccgggggaacgaggggaacggggaaacggggtcggtacgtaacggttaaacttacgttaacggtacgtaaaccgttaactaaacgtaacgaacgtaacgtaacgggttaaggttacggtttaatacggttagtacgtacggtacgggtcggacgggtacgaacgacgtcgtacgtaccgtcgtacgccgacgaacgcgccgtacccgccgtcnccgtcttcccgg

SEQ ID NO: 302470 - DNA, 544 bp, Homo sapiens
  misc_feature: GZ8MTXP02GABPP.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttattggatgacttgggtccgcaggctccgagggagggctggagtgggtggccagcgtgaagcatgatggaggtgaggaagactatggcggactctgtgaaggggccattcaccacttccagagacaacatcaaagaactacaattgtatctaccaaatgaagcaagcctagacaacgtccgaaggccaacgggtcccgtaggttattaccgtgtggcgaagtgtttcgttggggattggttgtccgttgctacacg

SEQ ID NO: 302471 - DNA, 505 bp, Homo sapiens
  misc_feature: GZ8MTXP02HYCF7.52.78.H01.1.454.CMB.2.raw
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatgtacagcagagcagcagccctatgtgatatataagactangagaggcctcagggatcctgagcgatctctcgctcctctacaggacaacngtcacgttgatcatcagtgagcggcgagaggacgagagtgatatatntaanatacaacagagagtagtagtagtatagtgtagtagtcggacggacggacgacgacgtacgtacgtacgtacgtacgacgaacgacgacgtaccgtacccgtccgtaccgtacgtcg

SEQ ID NO: 302472 - DNA, 527 bp, Homo sapiens
  misc_feature: GZ8MTXP02IFEAD.52.78.H01.1.454.CMB.2.raw
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacaggacggccaggatcacctgctctggagatgcactgccaaagcaatatgttatgtacagcagagcagccaggccccttatgtgatatataaggaccatagagacggccctcgagggactcccgtagacgcgtattcctctcggctcctcctacgagggaccaacgacgtacgtacgttgactctatcgtaggtggacgtccgggacgaggaggacgaggctagacttatactgtacaatcaacagacagtagtgtactagtgngtcaggttcggnggtaggaccaagcgtcgaccgtcgtagcgacgaccgacgctccgccctcgtcc

SEQ ID NO: 302473 - DNA, 553 bp, Homo sapiens
  misc_feature: GZ8MTXP02INTR6.52.78.H01.1.454.CMB.2.raw
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggcctcaggactccctgagcgattctctgctcctcctcaggacaacagtcacgttgatcatcagtggagtcccgggnaggaggagaggctagactatacngtacaatcaaacngacagtaagtcggtattatgtcgngtaaggtcggacgggtaagggaccaaagcgtacggaacccgttcgtaacgggtcaacggaaccccgaaacggccgttccggacccccgttcgggtcccaaccgtttccccg

SEQ ID NO: 302474 - DNA, 562 bp, Homo sapiens
  misc_feature: GZ8MTXP02GIM8V.52.78.H01.1.454.CMB.2.raw
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtccctgacactctcctgtgtagcctctggattcacctttaacagttatggatgacttgggtccnccaggctccgaggggaaggggctggagtggggtgccgagcggtgaagcatgagtggaggtgaggaagactagtgcggactgtgtaggaagggcgattcacctactccgagagaacaacatacaaagaactanaattgtatcacaaatgagcacgtccagacaacgtccgaagaccgtacggaccgttgtattacgtggtcgacggtacgttaggtttcgttgggggttcttggttcgttcgtacgacctacgcg

SEQ ID NO: 302475 - DNA, 497 bp, Homo sapiens
  misc_feature: GZ8MTXP02FVKEO.52.78.H01.1.454.CMB.2.raw
  modified_base (283)..(283): a, c, t, g, unknown or other
  misc_feature (283)..(283): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (493)..(493): a, c, t, g, unknown or other
  misc_feature (493)..(493): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagcaggccaggcccccttattggngatatataaggaccatgagaggccctcgagggatccctggagcgattctctggctcctctcaggacaacngtcacgttgatcatcagtgagtccggnagaggacgaggctagactatactgtacaatcaacagaacagtagtagtacttangtgnagttcggnggacggacagctgacgtcgtacgcagaacccgagctcgcccctgtcngtcc

SEQ ID NO: 302476 - DNA, 519 bp, Homo sapiens
  misc_feature: GZ8MTXP02IRL8V.52.78.H01.1.454.CMB.2.raw
  modified_base (222)..(222): a, c, t, g, unknown or other
  misc_feature (222)..(222): n is a, c, g, or t
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
  modified_base (513)..(513): a, c, t, g, unknown or other
  misc_feature (513)..(513): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttatggtacagcagagcaggccacggccccttatggtgatatataaggaccatgagacggcctgagggactcccngagcgattctctggcctcctcctcgaggaccaacngtccacgttagatcatcgagtgaggtcggnaggaggagagctagactatacgtgtacaatcaaacagacaggtagtaggtacttatgtagcgtaagtcgggacgtacgggacagcgtacgaccgtctaggcaacgcaacggctacgcccgtcggtacncttccg

SEQ ID NO: 302477 - DNA, 719 bp, Homo sapiens
  misc_feature: GZ8MTXP02H5E7K.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagcgtggtggagtcgtgggggagcgttggtccaggccgtgggggtccctgacactctccttgtttacgctcgtggatctaccttaacagttatggatgacttggtccgcaggctaccgaggggagggctggaggtggggtgccagcgtagaagcagtggatgggaggtagaaggaacgtacgtagtcggccggtacttcgtaggtacggaaggggcccgtattcccaacccttactacccgaaggacgaaaaccaaactattacccgaaaagtaaactctaaagttacgttaactcccttaaaccgaaaaagtcgaagaccgtaacgccgtagaaacctacgtacccggggaaacggaccgtaaccggggtacccgttttaggtaaaaccgtttttccgggacgggttaccggacgggtttaaaacggtttcggtttttacggggtttaagggggttaaccgtttgggttttaccgggttcggttaccggtaccccgttaaccggtaccgttcccccgg

SEQ ID NO: 302478 - DNA, 584 bp, Homo sapiens
  misc_feature: GZ8MTXP02FYC66.52.78.H01.1.454.CMB.2.raw
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagaggccaggccaggcccccttattggtgatatataaggaccatgagacggccctcgagggactccctggacgcgtattctctcggcctcctcctcgaggaccaacngtctacgttgactcatcagtgacgtccggcaggaggagagntgacttagttacgtgtacaattacaaacagaactaggtagttaggttacttagtagtgacgtaaggttcgggacggtaacgggaccgaaagtccgttacggaacccgttccgtaacggtccgaaccgaacccgtaacggaccgtcccggcccccgtacgtacccgtacctttccccgg

SEQ ID NO: 302479 - DNA, 501 bp, Homo sapiens
  misc_feature: GZ8MTXP02F33DN.52.78.H01.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggcagcccctatgngatanataaggaccatgagaggcctnaggatccctgagcgattctctggctcctcctcagggacaacngtcacattgatcatcagtgagtccggcagaggacgaggctgactatatagtcaatcaacagacagtagtgtactatgtgctagttcgcggtacggaccaaagcttagaccgtcacggtcaacgccgaaagccgttcgcccccgtcggttccaccg

SEQ ID NO: 302480 - DNA, 517 bp, Homo sapiens
  misc_feature: GZ8MTXP02IIKT5.52.78.H01.1.454.CMB.2.raw
  modified_base (302)..(302): a, c, t, g, unknown or other
  misc_feature (302)..(302): n is a, c, g, or t
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagngccagccagcccctatcgtgatatataaggaccatgagacggccctcagggactcccgtgacgcgtattctctggcctcctcctcagggaccaacncgtacacgttgactcaatcagtggagtcggcagaggacgagctagactatactgtacatacaacanacagtagtcggttacttatgttgcgaggttcggacggaggaccaagcgtacgg

SEQ ID NO: 302481 - DNA, 501 bp, Homo sapiens
  misc_feature: GZ8MTXP02FTKAZ.52.78.H01.1.454.CMB.2.raw
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgccaaagcaatatggttatggtaccagcagagcagcaggcccctatgngnatataaggaccatgagagcctcgagggatccctgagcgattcnctggctcctcctcagggacaaacagtcacgttgatcancgagtggacgtccggnagaggacgaggctgactattacngttcaatcaacagacagtatggtacttagtgtagctaggttcggacggaagggacccaaggctacgaccgtccgtagggtaccg

SEQ ID NO: 302482 - DNA, 586 bp, Homo sapiens
  misc_feature: GZ8MTXP02GYOWD.52.78.H01.1.454.CMB.2.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactcgaccaaagcaatatggttatggtaccagcagngcaggccacgccccttatggtgatatanaacggacagtcgagacggccctacgagggactcccgtggacgcgtattccgtcgtcggcctccgtcctcgaacgggaacaacgacgtactacgttcgattacacttaccgagttaggacggtacccgggacgagacgggaaccggaggcgtacggtacttattaacgtgtaactaatacgaacgtagactaggtagtaggttactaacgtgtagtcgtaggttcgggacggacggaaccgaacggtcgtaaccgg

SEQ ID NO: 302483 - DNA, 543 bp, Homo sapiens
  misc_feature: GZ8MTXP02JN406.52.78.H01.1.454.CMB.2.raw
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggacatgagaggccctagagggatcccgtgagcgtattaccctctggcctcctcctacgacgggacaaacgagtaccgacgttgaactcatcgagttggacggtccgggngaggaggacggaggccgtagactattacngtacaatcaanacgacagtagacggttattagtggtacgngaggttcggacggtaggaccaagcgtacgaccgtctaggcacgaccgagcgcgccccgcgtacccg

SEQ ID NO: 302484 - DNA, 537 bp, Homo sapiens
  misc_feature: GZ8MTXP02GAR4R.52.78.H01.1.454.CMB.2.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcaggccaggcccctatgngatatataaggacatgagagcctnagggactcccngagcgattctctcggcctcctcctcacgggacaaacngtcacgttgaatcgatcgagtgacgtccggacagaggacgagctagactatactgtaccaatcaaactagacagtacgtaggttacttatggtagcgtaagttcgggacggagggacccaaaggcttacggaccgtctaacggtcaacgcccgaacggctacgccccctaggccctagttcccg

SEQ ID NO: 302485 - DNA, 658 bp, Homo sapiens
  misc_feature: GZ8MTXP02IFOPE.52.78.H01.1.454.CMB.2.raw
  modified_base (284)..(284): a, c, t, g, unknown or other
  misc_feature (284)..(284): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggccccctatggngatatataagaccatgagaggccctcgaggactcccgtgagacgtattcctcgtccggtctcccgtaccgtaaacggaccgaaacacgtctaccgttgtactacatcaagtggacgtccgggccgaagaggacggaggcgtacgtaacgtacttacgtacgtactaaactaccgaaagaacgtaacgtaagtaagggttagttacgttaagtgtagacgtacggttacgggacgggaacgggaaccgtaaggtccgtaaccggtaaccggttacccgttaacgggtcccgtaaaccggacccgaaaccggggtcccgtacccggttacccccccgggtcggtaaccctacccggtttaccctttccccccgggg

SEQ ID NO: 302486 - DNA, 578 bp, Homo sapiens
  misc_feature: GZ8MTXP02JNFZ6.52.78.H01.1.454.CMB.2.raw
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgccaaagcaatatggttatggtaccagcagaggccaggccaggccccctattggtgatatataaggaccatgagacggccctcgagggactcccgtagacgcgtattctctcggctcctcctcgaggacaacngtcagttgactnatcagtgagtcccgganaggacggacgagcgtagactattactgtacaatcaacgagacgagtacgtaggtacttagtacgtgacgtagggttccggagggtaacgggacccgaggccgtacgggtaacccgtcgtaacgggtaccgacgaacccgaaacggtaccgtacccggtcccccgtcggtaccctaccgtttccccg

SEQ ID NO: 302487 - DNA, 533 bp, Homo sapiens
  misc_feature: GZ8MTXP02JH2WR.52.78.H01.1.454.CMB.2.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (413)..(413): a, c, t, g, unknown or other
  misc_feature (413)..(413): n is a, c, g, or t
  modified_base (452)..(452): a, c, t, g, unknown or other
  misc_feature (452)..(452): n is a, c, g, or t
  modified_base (513)..(513): a, c, t, g, unknown or other
  misc_feature (513)..(513): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttatggtaccagcagaggccaggccacggcccccttatggtnatatataagaccatgagacggcctacgagggactcctgagcgattctcgtggcctcctcctcgagggtacaacngtcacgttgatcgatcgagtggacgtccggganaggaggacgaggctagacgtattacgtgtacagtcaaangtaacagtacgtgttactagtaggtcgacgtacgttcggacgggtaaggaccaacggtcgngacccgtcgtacggtaaccg

SEQ ID NO: 302488 - DNA, 518 bp, Homo sapiens
  misc_feature: GZ8MTXP02ISLJ4.52.78.H01.1.454.CMB.2.raw
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggcccccttattggtgatatataaggaccatgagaggccctgaggatccctgagcgattctctcggcctcctctcgaggacaacngtcacgttgatcatcagtgagtccgganaggaggagagcngactattacngtacaatcaaactagacagtagtaggttactagtgtgctaggtcggaggacggaccaggcgtacgaccgtcgtacggtcacgcccgaagcgtacgcccctcggtcactcccg

SEQ ID NO: 302489 - DNA, 555 bp, Homo sapiens
  misc_feature: GZ8MTXP02GHDRM.52.78.H01.1.454.CMB.2.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (344)..(344): a, c, t, g, unknown or other
  misc_feature (344)..(344): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttatgtaccagcagagcagcacgccctatgngatatanagacatgagacgcctgaggactcctgacgcgattctgtcggctcctcctacgaggacaacngtcacgttgatcatcgagtgcgtcggacagaggagaggctagactatactgtacatacaacagacaggtatacggttaatagtacgttgacgttacgggttacgggacgggtaacggggaaccctaaaggccgttacggaaacccgtcgtaacggtcgaaccggtccgaaacggtccgtaccgtcccccgtacgggtaccctcgtttcccg

SEQ ID NO: 302490 - DNA, 508 bp, Homo sapiens
  misc_feature: GZ8MTXP02GZUDM.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttatggtaccagcagagccaggccaggccccttatcggtgatatataaggaccatgagaggccctcgagggactcccgtgagcgtattcctctgctcctctcagggacaacagtcacgttgatcatcagtggagtcggcagagacgagctgactattactgtcaatcaactagacagtagtaggtattagtgtgctaggttcggacggaggaccaagcgtacgaccgtcgtagcgacgccgagcctcgccccgtcggtccc

SEQ ID NO: 302491 - DNA, 610 bp, Homo sapiens
  misc_feature: GZ8MTXP02G2HCC.52.78.H01.1.454.CMB.2.raw
  modified_base (262)..(262): a, c, t, g, unknown or other
  misc_feature (262)..(262): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccacctcggtgtcagtgtcctcaggacagacggccaggatcacctgctctgganatgcactgccaaagcaatatggttatggtaccagcagaggccaggccaggtcccccttagtcggtgatatataaggaccatcgagacgccctcgagggacttccctggacgcgattcctcgtcggcctccctcctcgacggacaacgtagtcgtacgttgactacctagtaccgagtacgggacgttaccggggacgaagggacgggacgggaggccgttaaggtaccttaagttaccgtacggtaacgtaaaacgtactaaaacgacgtaactacgggttagttacggttacttaacgtgttacgcgtacggttcgggacgggaacgggaccgaacgcgttaaccgg

SEQ ID NO: 302492 - DNA, 528 bp, Homo sapiens
  misc_feature: GZ8MTXP02IC64L.52.78.H01.1.454.CMB.2.raw
  modified_base (279)..(279): a, c, t, g, unknown or other
  misc_feature (279)..(279): n is a, c, g, or t
  modified_base (328)..(328): a, c, t, g, unknown or other
  misc_feature (328)..(328): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtacagcagagcagcagcccctatgngatatataaggaccatgagaggccctcgagggatccctgagcgattccnctggctcctcctcgagggcaacagtcacgttgatcatcagtgagtccggcagaggacggaggcgtagacgtattactgttacaagttacaacagaccagtagtagtacttaagttgtgtcgtagttcggacggagggaccaaaggcgtacgacccgtcgtaggtcgacgacccgaacggccgtccgccccgtcggtaccc

SEQ ID NO: 302493 - DNA, 571 bp, Homo sapiens
  misc_feature: GZ8MTXP02HL4A8.52.78.H01.1.454.CMB.2.raw
  modified_base (309)..(309): a, c, t, g, unknown or other
  misc_feature (309)..(309): n is a, c, g, or t
  modified_base (568)..(568): a, c, t, g, unknown or other
  misc_feature (568)..(568): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtccctgacactctcctgtgtagcctctggattcacctttaacagttattggatgacttgggtccnccaggctccgagggaggggctggagtgggtgccaggcgtgaagcatgatggaggtgaacggaagactatggcgggactcgtgtaggaaggggccgtattcgaccacttccaagacgaacaacatacaaagaactcaatgtatctaccaaaatgagacagccctaggacacgtccggaagaccgacgggtccgtagttacttaacgtggtcgcggacgtagtttcgttgggtattgtttcggtcgtttcgaccgttaacncgg

SEQ ID NO: 302494 - DNA, 527 bp, Homo sapiens
  misc_feature: GZ8MTXP02H6JME.52.78.H01.1.454.CMB.2.raw
  modified_base (376)..(376): a, c, t, g, unknown or other
  misc_feature (376)..(376): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccccttatcggtgatatataaggaccatgagaggccctcgagggatccctgagcgattcctctggctcctctcagggcaacagtcagttgatcatcagnggagtccgggcagaggcggaaggctaggactagttactgtacaaattacaacagacagtagtgttactaatgtagctaggttcggcgggaggacaaaggcttcgaccgtccgtaggtcacgaccaacgggctaccggtcccctcggtaccc

SEQ ID NO: 302495 - DNA, 554 bp, Homo sapiens
  misc_feature: GZ8MTXP02IUQQU.52.78.H01.1.454.CMB.2.raw
  modified_base (356)..(356): a, c, t, g, unknown or other
  misc_feature (356)..(356): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagcaatatggttatggtaccagcagagccaggccaggccccttatggtgatatataaggaccatgagaggccctgagggctccctgagcgtatctctcggctcctcctcgaggaccaacngtcacgttgatcatcagtgacgtcggcaggagacgagctgactntacngtacaatcaacagacagtagtaggttacttagtgtagctaaggttcgggacgggtacggaaccaagtcgtacggtaaccgttcccgtaaggtacccacgtaacccgaaacggtccgtcccggcccccgtcggtacctacccgtttcccgg

SEQ ID NO: 302496 - DNA, 549 bp, Homo sapiens
  misc_feature: GZ8MTXP02INP6T.52.78.H01.1.454.CMB.2.raw
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctatttagaaggtgtccagtgtgaggcgcagctgggtggagtcgtgggggaggcttggtccagccgtgggggtcctgacactctcctgtgtagcctctggattcacctttaacagttattggatgacttgggtccgcaggctccgagggagggctggagtgggtgccagcgtgaagcatgatggagtgaggaanactatggcgactcgtgtggaaggggccattccgacacttccaagagaacaaacntacaagaacncaatgtatcacaatgagacagccctgacagtccgaaggacaccgggtccgtagtaacttacgtgtacgcgtagtagtttcgtttaagggtattggtttcggtcgtttacggcaaccgtcgg

SEQ ID NO: 302497 - DNA, 776 bp, Homo sapiens
  misc_feature: GZ8MTXP02GZ2LY.52.78.H01.1.454.CMB.2.raw
  modified_base (225)..(225): a, c, t, g, unknown or other
  misc_feature (225)..(225): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtaccagcagagcaggccaggccccttatggtgatatataaggaccatgagacggccctacgagggactcccgtgacgcgtattccctcgtcggtcctcctccctcgacgggaccaaacgtagtaccgtacgtttacgaacttaccgaacttacccgtaagggtttacgggggaaccgggttaccccgggggacccgtaaaggggtaacgggggaacccgggaaacggggtcccgttaacggtaaccccgtttaaagttttaaaccccgttagggttaacccgtaaaactttacccgtaaaaaccgaaacgggtaaaccctaaagggtttaaacggtttacggggtttaaacctttaaggttaccggttagtaccgttacgggtttaccggggacggggttaaaccggggaaacccgtaaacgggtaccgtaccggtaacccggttacccggtaaacgggttaaccgaaccggaccccgaaacgggtcccgtacccggtccccccgttacgggttaaccccg

SEQ ID NO: 302498 - DNA, 515 bp, Homo sapiens
  misc_feature: GZ8MTXP02FZ2X2.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggtcaggcccccttatggtgatatataaggaccatgagaggccctcagggatccctgagcgattcctctggctcctcctcagggacaacagtcacgttgatcatcagtggagtcggcagagacgagctgactattactgtacaatcaacagaacaagtagtaggtacttatgtagtcaggttcggcggagggaccaaagctcgaccgtcgtaggtcacgaccgaacgcctcgcccccgtggtaccc

SEQ ID NO: 302499 - DNA, 578 bp, Homo sapiens
  misc_feature: GZ8MTXP02HUBCK.52.78.H01.1.454.CMB.2.raw
  modified_base (401)..(401): a, c, t, g, unknown or other
  misc_feature (401)..(401): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatgttattggtaccagcagagccaggccacggcccccttatggtgatatataaggaccatgagaggccctgaggctccctgacgcgattcctctgctccctctcgagggcaaacgactctacgttgactcatcagtggagtccgggcgagaggacggnggctgactattactgtacaatcaacgagacgagtagtgttaacttatgtagcgtaggttcgggacgggtagggaacctaaacggggccttacgggaacccgttccggttacgtaaccggtaaccggaccccgaacgggtaccgttccccggtccccccggtttacgggttacccccg

SEQ ID NO: 302500 - DNA, 542 bp, Homo sapiens
  misc_feature: GZ8MTXP02JFZSM.52.78.H01.1.454.CMB.2.raw
  modified_base (282)..(282): a, c, t, g, unknown or other
  misc_feature (282)..(282): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (451)..(451): a, c, t, g, unknown or other
  misc_feature (451)..(451): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttatggtaccagcagagcaggccaggcccccttatggngatatataaggaccatgagaggccctgagggactccctgacgcgattctctcggcctcctcctcgagggaacaacngtcacgttgatcatcagtgagtccggnagaggacgaggctagactattacgtgtacaaatcaaactagaactagtacgtaggtacttagtgtncgtaggttcgggaggacgggactaaaggcgtacgaccgtcgttacggcacgccgaacggtccgtaccgtccccgtcggtccacgtttcccg

SEQ ID NO: 302501 - DNA, 653 bp, Homo sapiens
  misc_feature: GZ8MTXP02G38CQ.52.78.H01.1.454.CMB.2.raw
  modified_base (583)..(583): a, c, t, g, unknown or other
  misc_feature (583)..(583): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactaaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttattggatgacgttgggtccgccgaggctccgaggggaagggctgggaggtggggtcggccgaggcgtagaagcatggagtgggaggtgaaggaagtactagtcggcgggtactcgtggtaggaacggggtccgtagttacccaaaccctacttacccgaaaggaacgaacaaaccgtataccgaaaacgtaacttacaaaagttgtaaactacccttaaccaaaagttcgaacgcaacgtcccgtagaaccacgtacccggaaggaccgaccgggtccgttagtaacgtttcgnggtaggacgtaagttaggttttcggtttaggggaatttggttcggttcgtacggacctaacgcggtcccg

SEQ ID NO: 302502 - DNA, 668 bp, Homo sapiens
  misc_feature: GZ8MTXP02JR98E.52.78.H01.1.454.CMB.2.raw
  modified_base (307)..(307): a, c, t, g, unknown or other
  misc_feature (307)..(307): n is a, c, g, or t
tcagcgcagtacgacacgaccggtgctcgatttagtgtgagtagtttgggtttggggctgggagcctagctgtgctgtgggtccaggaggcagaactctgggtgtctcaccatggcctggatccctctacttctcccctctcactctctgcacaggctctgggcctcctatgaactgacacagccaccctcggtgtcagtgtcctcaggacagcggccaggatcacctgctctggagactgctacgtgaccaaagcaatagtggtattcggaccagcagagccgagccgacggtccccttagtcggngtataagtagttaacggactatgagtcggcctaccgagggtactcccgtagacgcgtcttcgtcgtggcctcctcgcgacgggaccaacgcgtaccgtaagttcggacttacaaccgtcgtaaggttcgggaaacggttcccgggacgttaaagggaccggtttaaagggacggttccgagtaacccggttaattaaccgttggaccttaaaggtaacgtaacctaagaaccgtaacggttaacggttaacgggttacgtttaaacggttacggtaggtccgtaaaccgggtttcgggtacgggtaacgggtaacggtaaccggaccggtaccgtaaccggtccggttaccggtaacccgg

SEQ ID NO: 302503 - DNA, 626 bp, Homo sapiens
  misc_feature: GZ8MTXP02H9ZT2.52.78.H01.1.454.CMB.2.raw
  modified_base (354)..(354): a, c, t, g, unknown or other
  misc_feature (354)..(354): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggccaggccaggccccctatggtgatatataaggaccatgagaggcctcgagggatcccgtgagcgatctctcggctcctcctcgaggacaacngtcgtacgttgactcatcagtgacggtccgggacgaggaagggaccgagggcgtagtaacgtaagtttacgtaggtaacctaaattaccaaaaccgtaagaaccgtaagggtaaggttacgggttaactttaagttgtaggtacgtagggttccgggggacggggaacggggaacccgaaaggtccgtacggacccggttaccgtacgggttacacggaacccgtaaaggccgtacccggtcccccgtcgggtaaccctaccggtttccccg

SEQ ID NO: 302504 - DNA, 551 bp, Homo sapiens
  misc_feature: GZ8MTXP02F1LFE.52.78.H01.1.454.CMB.2.raw
  modified_base (363)..(363): a, c, t, g, unknown or other
  misc_feature (363)..(363): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggcccccttatggtgatatataaaggaccatgagaggccctcgagggatcccgtgagcgattctcgtcggcctccctctcgagggacaacgngtcacgttgactcatcagtggagtccgggcaggaggacgaggctagaacttattactgtacaatacaacagactagtagtacgtacttatgtgcgtagttcggacggtacggaccaagcgtacggaccgtcgtaacggtccgacgaacccgaacggcctccggtcccccgtcggtacctacgttcccg

SEQ ID NO: 302505 - DNA, 567 bp, Homo sapiens
  misc_feature: GZ8MTXP02JEO9Q.52.78.H01.1.454.CMB.2.raw
  modified_base (424)..(424): a, c, t, g, unknown or other
  misc_feature (424)..(424): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctacgagggatccctgagcgtattcctctcggctcctctccgagggacaacagtccacgttgatcatcagtggacgtcgggacaggaggacgaggctgactattactgtanaatcaaacagaacagtagtaggtacttagtgtagcgtaggttacgggacgggtagggaacccgaaaggcgtacggacccgtaccgtagggtaaccgacggtacccgaaacggggtcctacccggtacccccgtcggttacccg

SEQ ID NO: 302506 - DNA, 573 bp, Homo sapiens
  misc_feature: GZ8MTXP02G9BMO.52.78.H01.1.454.CMB.2.raw
  modified_base (353)..(353): a, c, t, g, unknown or other
  misc_feature (353)..(353): n is a, c, g, or t
  modified_base (381)..(382): a, c, t, g, unknown or other
  misc_feature (381)..(382): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccaggcccccttatggtgatatataaggaccatgagagccctcagggatccctgagcgattcctctgctcctctcagggcacngtcacgttgatcatcagtggagtccggnngaggacgngctgactatactgtacaatcgaactaggaacagtagtaggtacttagtgttacgacgtacggtttacgggacgggaacgggaacccgaaagtccgttaccggaaacccggttcccgttaacgggtcccgaacggtaccccgtaaacggccgtacccggtccccccgttaacgggttacccccg

SEQ ID NO: 302507 - DNA, 545 bp, Homo sapiens
  misc_feature: GZ8MTXP02HBPFO.52.78.H01.1.454.CMB.2.raw
  modified_base (307)..(307): a, c, t, g, unknown or other
  misc_feature (307)..(307): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggtccnccaggctccgaggggagggctggagtgggtgccagcgtgaagcatgagtggagtgaggagactatgcggatctgtgaagggcatcacactcagagacaacataaagaactanatntatctacaatgagcacgcagactacgacggacggacgacggtacgttagtacttacgtgtcgacgtacgtacgtttcggttaggtaagtttcggttacggttcgttcgacctaccgacgtccg

SEQ ID NO: 302508 - DNA, 510 bp, Homo sapiens
  misc_feature: GZ8MTXP02H95GA.52.78.H01.1.454.CMB.2.raw
  modified_base (350)..(350): a, c, t, g, unknown or other
  misc_feature (350)..(350): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggccccctatcggtgatatataaggaccatgagaggccctcagggatcccctgagcgattcctctggctcctcctcngggcaacagtcacgttgatcatcagtggagtcgggcagaggacgaggctgactagttactgtacaatcaacagacagtagtggtactatgtgcagttcggcggagggaccaaagcgtacgaccgttcctaggtcgacgccacgggctcgcccctcggtcc

SEQ ID NO: 302509 - DNA, 569 bp, Homo sapiens
  misc_feature: GZ8MTXP02GWTJP.52.78.H01.1.454.CMB.2.raw
  modified_base (189)..(189): a, c, t, g, unknown or other
  misc_feature (189)..(189): n is a, c, g, or t
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (485)..(485): a, c, t, g, unknown or other
  misc_feature (485)..(485): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcatatgaactgacacagccaccctcggtgtcagtgtcctnaggacagacgccaggatcacctgctctgganatgcactgaccaaagcaatagtggttatggaccagcagagccaggccacgccccttagtgngatataataagacagtgaagacgccctagagggactccgtagacgcgtattcnccgtggcctcctccgtcgacgggtaacacgtacgtacaacgttgatacattcaggtgtaacggtccgggacgaggaacggacgacggactaggaacttattacgtagtacaaatacaacgtagaacgtagtaagttacggtattagtgtanacgtaggtcggacggacggaaccacgtcgtacgaccgtccgtaacgcgaacgcccgaaggccctcgcccccgtggtacctaccg

SEQ ID NO: 302510 - DNA, 521 bp, Homo sapiens
  misc_feature: GZ8MTXP02I0QWG.52.78.H01.1.454.CMB.2.raw
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccagcccctatggngatatataaggaccatgagaggcctcgaggatcctgagcgattctctcggctcctctcgagggacaacngtcacgttgatcatcagtggacgtccggganaggaggacgaggctagacttatacgtgtacaaatcaacgagaacaggtagtggtacttagtgtgcgtaggtggcggacggaccgagcgtagaccgtcgtacgcgaccgccgaacggctcgcccccgtcggtccacgttccg

SEQ ID NO: 302511 - DNA, 648 bp, Homo sapiens
  misc_feature: GZ8MTXP02HNY98.52.78.H01.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctctcactctctgcacaggctctgggcctcctatgaactgacacagccacctcggtgtcagtcgtcctcaggacaggaccggccaggactcacctgctcgnggagactgcacttgaccaaagcaatagtgttattggtacagcagacgccgaggccgacggtcccctagtcggntatatataaaggccagtgagacggcctacgacgggactcccgtagacgcggtattcgtcgtcgccttcccgtacctacgagggaaccaaacgngtacctacggttaagactacgtactacgtacgtacggtacgtacggacgaacggacggacggtacggtactacgttacgttaacgttacgtacgtaactaacgtaacgaacgtaacgtaacgtaacggttaacggttacgttaacgttacggttacggttacggtacggtacgggtacgggtaacgggtaacggtaacggtaacggtaccggtaccggtaccggtaccggttaccggtaccgg

SEQ ID NO: 302512 - DNA, 622 bp, Homo sapiens
  misc_feature: GZ8MTXP02IXSF5.52.78.H01.1.454.CMB.2.raw
  modified_base (277)..(277): a, c, t, g, unknown or other
  misc_feature (277)..(277): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtacagcagagcagccacgcccttatgngatatatagacatgagacgcctacgacggactcccgtgacgtcgtattctcgtcggtcctccctccgtacgacgggaaccaacgcgtcgtacggttagacttcaactacgaggtggtacggtccgggacgaagggacggaacgagtctaggtaacttagttactagtaacaacttaaccgaaacgtaacgaacgtaaggttaaggttacggttaacgttaagtggtagtacggtacggttacgggacggtaacgggaacgacgtcggtacgtaaccggtacgtacggtaccacgtcccggaaacgtcccgtccggacccccgttaccggtactacccgtttcccg

SEQ ID NO: 302513 - DNA, 576 bp, Homo sapiens
  misc_feature: GZ8MTXP02IGVUJ.52.78.H01.1.454.CMB.2.raw
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagaggccagccaggccccctatggtgatatataaggacatgagaggccctcgagggactcccgtgagcgagttctctcggcctccctcctcgacggaaccaactgtcctacgttgatccgatcagtggagtccgganagaggagagcgtnacgtattacgngttacaaatacgaactagaacgtaggtagttggtaacttagtgtagtgtacgggttcgggcggaacggtaccgaaagtccgtacggacccgttacgtacggtacaaccggaaccgaaacggtccgtacccggtcccccgtcggtcctaactttccccg

SEQ ID NO: 302514 - DNA, 516 bp, Homo sapiens
  misc_feature: GZ8MTXP02FWIFE.52.78.H01.1.454.CMB.2.raw
  modified_base (351)..(351): a, c, t, g, unknown or other
  misc_feature (351)..(351): n is a, c, g, or t
  modified_base (397)..(397): a, c, t, g, unknown or other
  misc_feature (397)..(397): n is a, c, g, or t
tcagcgcagtacgacacgaccggtgctcgatttagtgtgagtagtttgggtttgggggtgggtccaggaggcagaactctgggtgctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggcaggccccttatgtgatatataaggaccatgagaggccctcgagggatcccgtgagcgattctctcggctcctctcagggacaacngtcacgttgatcatcagtgagtcggcagagagagctgactattacngtacaatcaacagacaggtagtaggtacttagtgtgcgtaaggttcggcggacgggaccaaagcgttacgaccgtcgtacgtcacgccgaaacggcctcgccccgtcggtccacttccg

SEQ ID NO: 302515 - DNA, 594 bp, Homo sapiens
  misc_feature: GZ8MTXP02JHAZS.52.78.H01.1.454.CMB.2.raw
  modified_base (309)..(309): a, c, t, g, unknown or other
  misc_feature (309)..(309): n is a, c, g, or t
  modified_base (539)..(539): a, c, t, g, unknown or other
  misc_feature (539)..(539): n is a, c, g, or t
  modified_base (569)..(569): a, c, t, g, unknown or other
  misc_feature (569)..(569): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctggtggagtcgtgggggaggcttggtccaggccgtggggggtccctgacactctcctgtgtagcctctggattcacctttaacagttatggatgacttgggtccnccaggctcgagggagggctggagtgggtgccagcgtgaagcatgatgggaggtgaggaagactagtggcgggtactcgtgtaggaacgggccgtattccacctacttccaaggacgaacaacatacaaagaaccttacaaattaggtactaccgtaaccaaaagttcgaagccaacggtccctaggaccagtacccggaaggaccaccgggtccgttaggtatttaccgnggttcgacgaacgtgtttcgttaaggggtnttcggttcgtcgtacgacctacgcg

SEQ ID NO: 302516 - DNA, 532 bp, Homo sapiens
  misc_feature: GZ8MTXP02FQAPJ.52.78.H01.1.454.CMB.2.raw
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
  modified_base (435)..(435): a, c, t, g, unknown or other
  misc_feature (435)..(435): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggccaggcccctatggngatatataaggaccatgagaggccctcgagggatccctgagcgattctctcggctcctctcagggacaacngtcacgttgatcatcagtgagtccggcagaggacgagctgactatactgtacaatcaacagacagtagtggtacttagtgtgngtagttcgggacggtacggggaccaaaggtcgtacggaccgtccgtacggtcacggcccgaaacggcgtccggcccccgtcggtaccacgtttcccg

SEQ ID NO: 302517 - DNA, 698 bp, Homo sapiens
  misc_feature: GZ8MTXP02I8WRV.52.78.H01.1.454.CMB.2.raw
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtagatatataaggaccatgagacggccctacgagggactcccgtgacgcgtattcctcgtcggccttacccgtcctccgacgggaccaaacgtacggtacctaccgtttgaactttccgaaagttccgaaggttacggggaacggttcccgggggacgaaaggggacgggaaccgggaaggtccgtagggtaaaccttaagtttaacgtacggttaacctaacgttaccaaaaccgtaaggaaaccgtaacgggtttaaggtaccggggtttaaactttaacgtggttacgaccgtagggtttaccggggacggggtacggggaaccgaaacggtcgttacggaacccggttcgtacggttaaccgaccggacccggtaacggccgtacccggcccccgttacggttacccg

SEQ ID NO: 302518 - DNA, 556 bp, Homo sapiens
  misc_feature: GZ8MTXP02F67LW.52.78.H01.1.454.CMB.2.raw
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (353)..(353): a, c, t, g, unknown or other
  misc_feature (353)..(353): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtacagcagagcaggcacgccctatgngatanataagacatgagacgcctcgaggactccctgacgcgtattctcgtcggcctcctcctacgacggaacaacngtcacgttgatcatcgagtggacgtcggcgagaggacgagctgactatactgtacaatacaacgagactaagtagtaggtacttagtgtagcgtaagggttcgggacggaacgggaccgtaaagcgtacgtaccggtacgtaacggtcgaccgaaccgaacggccgttacccggcccccgttcggtaaccgtacctttcccgg

SEQ ID NO: 302519 - DNA, 569 bp, Homo sapiens
  misc_feature: GZ8MTXP02GDMAV.52.78.H01.1.454.CMB.2.raw
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagccaggccacggccccttatggtgatatataaggaccatagagacggccctcgagggactcccgtgagcgtattcctctcggctcctctcgagggacaacagtcacgttgatcatcagtggacgtcggnagaggacgaggctagactattacngtacaatcaaacagaacaagttacggtagttaacgttaatggtagacgtacgggttacgggacggggaacgggaacccgaaaggtccgtacggaaccgttcccgtaaaggtccgacgacccgaacggcctccggcccccgtcggttaccccg

SEQ ID NO: 302520 - DNA, 524 bp, Homo sapiens
  misc_feature: GZ8MTXP02IRMXJ.52.78.H01.1.454.CMB.2.raw
  modified_base (281)..(281): a, c, t, g, unknown or other
  misc_feature (281)..(281): n is a, c, g, or t
  modified_base (451)..(451): a, c, t, g, unknown or other
  misc_feature (451)..(451): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcagccacggcccctatgnatatataagacatgagacggcctgaggactccgtgacgcgtattctctcggtctcctcctcgaggacaactgtcacgttgatcatcgagtaggacggtccggacaggacgggacgagggctaggaactaatacgtatacaatacaactagacagtagagttactatgtancgtaagtcggacggaggacagctacggacctcgtacgcacgaaccgacggctcccgccgcgtaccacttcccg

SEQ ID NO: 302521 - DNA, 540 bp, Homo sapiens
  misc_feature: GZ8MTXP02JM60R.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccaggcccccttatcggtgatatataaggaccatgagaggccctcgagggatcccgtgagcgattctctcggcctcctcctcgagggacaacgcgtcacgttgatcatcagtggagtcccgggcaggaggacgaggctaggactatactgtacatacaacagacaggtatggtacttagtgtgcgtagttcggacggtacggacaaggctacggaccgtcgtacggtcgacgtaacccgaaggtccgtcgcccccgtacggtcctacttcccg

SEQ ID NO: 302522 - DNA, 583 bp, Homo sapiens
  misc_feature: GZ8MTXP02IU7C0.52.78.H01.1.454.CMB.2.raw
  modified_base (361)..(361): a, c, t, g, unknown or other
  misc_feature (361)..(361): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcatgaccaaagcaatatggttatggtaccagcagagcaggccacggccccttatcggtgatatataaggacatgagacggccctgagggactccctgacgcgtatctcgtcggacctcctcctcgacggacaacgngtcacgtgattcatcgaggtagacggtcccggagagggacggaaccggaggtccgtagtaacgttacgttaacctggttaacaaacgttacaaacgtagaacgtaggtaagtagttaacgtagttggtagacgtaggtcggacggaacgggacaaggctacggaccgtcgtaacgtcgacgaaccgacggtcgtccgccccgtacggtaccgacctttcccg

SEQ ID NO: 302523 - DNA, 723 bp, Homo sapiens
  misc_feature: GZ8MTXP02HROE8.52.78.H01.1.454.CMB.2.raw
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
  modified_base (521)..(521): a, c, t, g, unknown or other
  misc_feature (521)..(521): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccaggccgtgggggtccctgacnctctcctgtgtacgcctcgtggtacttcctacctttaacagtttagttggaatggtacgttcggggtcccnccgagggcctaccggagggggaacggggcgtaggggtaggtggggtcggccgtaggcgtaggaaagtcagtgagtggggaggtagaaggtaagactaagtacggtactcgtaggacgaacggggcctattacccgaaccttaccgttacccgaaagaaacgaaccaaaactacgttaaccaaaagtaaaccccttanaaaagttcgttaaacttccttaaaccgaaaagttcggaacgacgacgtaccctaggaacctacggacccggaaggaaccggtaccgggtccgttagttaacgtttaccgggtcggtacgtacggtttaacgggttcggtttttcggttagggttaacgtttcgggtttacggttaccgtacgtacccgtaccgtcgtccccg

SEQ ID NO: 302524 - DNA, 575 bp, Homo sapiens
  misc_feature: GZ8MTXP02HWWTF.52.78.H01.1.454.CMB.2.raw
  modified_base (350)..(350): a, c, t, g, unknown or other
  misc_feature (350)..(350): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggttatggtaccagcagagccaggccaggcccctatggtgatatataaggaccatgagaggcctcgagggatcccgtgagcgtatctctcggctcctctcgaggacaacngtcaacgtgatcatcagtgagtcggcagnggacgtagctagactatctagtcaatcaanagacagtagtaggtacttagtgtgcgtaaggttccgggaggtacgggaacccgaaaggtcgttacggaaacccggttccgtaacgggggttaccaacgggtaaccccgaaaacgggcccgttaacccggacccccccgtttccggggccctaaccgtttcccccgg

SEQ ID NO: 302525 - DNA, 563 bp, Homo sapiens
  misc_feature: GZ8MTXP02GAA5I.52.78.H01.1.454.CMB.2.raw
  modified_base (358)..(358): a, c, t, g, unknown or other
  misc_feature (358)..(358): n is a, c, g, or t
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttattggtgatatataaggaccatgagacgccctcgaggactccctgagcgattctctcggctcctctcaggacaacngtcacgttgatcatcagtggagtccggcagaggacgagctgacttattactgtacaatcaactagactagtagtagtacttagtgtcgngtaggttcgggacgggacgggaaccaaggtccgttacggaacccggttccgtaacgggtccacggaaccccgtaacggtccgtcccggtcccccgtcggttacctaccgtttcccg

SEQ ID NO: 302526 - DNA, 589 bp, Homo sapiens
  misc_feature: GZ8MTXP02GDWP0.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacgccaggatcacctgctctggagatgcactgaccaaagcaatatggttattggtaccagcagaggcaggccacggccccttatggtgatatataaggaccatagagacggcctcgaagggactccccgtagacggcgtaagttcctctgggcctcctcctacgacgggaaccaacgtacgtcacgttgactcatcagtggagtccggcaggaggacggtagcgtagaacgtacttacgtgtacaaagttacaactagactagtacgtaggtacttatggtgacgtaggtccggcgggtaacggacccgaaagcgtacggaccgtcccgttaaggccgaacgaacccggaaaggtcccgttcccggcccccgtcggtacctaccgtttcccg

SEQ ID NO: 302527 - DNA, 581 bp, Homo sapiens
  misc_feature: GZ8MTXP02IE69V.52.78.H01.1.454.CMB.2.raw
  modified_base (268)..(268): a, c, t, g, unknown or other
  misc_feature (268)..(268): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
  modified_base (573)..(573): a, c, t, g, unknown or other
  misc_feature (573)..(573): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagctgggttttccttgttgcttattttagaaggtgtccagtgtgaggcgcagctggtggagtcgtgggggagcttggtccagccgtgggggtccctgacactctctgtgtagcctcgngtattcaccttacagttatggatgacgttcgggtccgccaggcctaccggaggggaaggggtcctagggaggttggggcggccaggcgtagaaagcagtgacgtggaggtgaggaagtactagtggacgtatcgtagtaggaacggggctacttcccactacctaccagaagaaccaaanactaacaaactaactanaagtatactacaactaagtagacgcgacgctacgacgacgacggacgtacgacggtacgttagtatcgtagcgacgtagttagttagttggtattcggttcgtcgtcncgacgtcg

SEQ ID NO: 302528 - DNA, 583 bp, Homo sapiens
  misc_feature: GZ8MTXP02F5TMK.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccaggccccttatgtgatatataaggacatgagaggccctcgaggactccctgagcgattcctctggctcctctcgagggacaacagtcgtacgttgatcatcaaggtggacgtcgggacgagacgggacggtaggcgtcggaacttatactcggtactaacttacgaaccaagaaccgtagtaggttaggttacgttaagttgtacgtacgtacggttcgggacggggaacgggaccgtaaaggccgttacggtaacccgtcgttaccgggaacgaccggacccgaacggcgtcccgtccccgtacggtcccg

SEQ ID NO: 302529 - DNA, 538 bp, Homo sapiens
  misc_feature: GZ8MTXP02IRK1Y.52.78.H01.1.454.CMB.2.raw
  modified_base (221)..(221): a, c, t, g, unknown or other
  misc_feature (221)..(221): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctgganatgcactgaccaaagcaatatggttattggtacagcagaggcaggccaggccccttatgngatatataggacatgagagcctnagggactccctgacgcgtattctcgtcggcctcctcctcgaggaccaacngtcacgttgatcatcgagtgagtccggganaggaggacgaggctagacttatacngtanaaatcaaacngacgagtacgtagtacttagtcgtgactaggtcgacgggtacggaccaaaggctacggaccgtacgtacggtacgacgaaccgaacggtctccgcccgtccggtcctaccttccg

SEQ ID NO: 302530 - DNA, 547 bp, Homo sapiens
  misc_feature: GZ8MTXP02GI2PL.52.78.H01.1.454.CMB.2.raw
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccacggcccctatggtgatatataaggaccatgagacggccctcgagggactccctgagcgattctctcgctcctctcgacggacaacngtacacgttgatcatcgagtaggacggtccggganacgggaggacggaggccgtagactattacgtgtacaaatcaacagactaggtagtagtacttagtgtgcgtaaggttcgggaggacggacagcgtacgaccgtccgtacggtcacgaaccgaacggccgtaccgccccgtcggtacctacttccg

SEQ ID NO: 302531 - DNA, 596 bp, Homo sapiens
  misc_feature: GZ8MTXP02H4TFF.52.78.H01.1.454.CMB.2.raw
  modified_base (220)..(220): a, c, t, g, unknown or other
  misc_feature (220)..(220): n is a, c, g, or t
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccagatcactgctctgganatgcactgaccaaagcaatatggttattggtaccagcagagcaggccaggcccctatggtgatatataaggaccatgagaggcctgagggatccgtgagcgtatcgtctcggctacctcctcgaggacaacngtcgtactgatcatcagcggtacgcggacgaggaacgggacgacggtctaggtaaccttagttacgtcgttaacaacgttaaccaaaacgtagaacaaggttagttaggttaacgttaagtggtgtacgtaacgggttcgggacgggtaacgggaaaccgtaggtctacggaccgtacccgtaaggtccaacggtaacccgaaacggtccgtacccggccccgtcggtacctaccggttccccg

SEQ ID NO: 302532 - DNA, 519 bp, Homo sapiens
  misc_feature: GZ8MTXP02IESR2.52.78.H01.1.454.CMB.2.raw
  modified_base (358)..(358): a, c, t, g, unknown or other
  misc_feature (358)..(358): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttaattggtaccagcagaggccaggccaggcccccttattggtgatatataaggaccatgagacggcctgagggactccctgagcgattctctcggctcctctcagggacaacngtcacgttgatcatcagtggagtccggcaggaggacgaggctagactatactgtacaatacaacagactagtagtgtacttatgtgcagttcggcggtagggaccaaggcgtgaaccgtcgtacggtcacgccgtaaggctacgcccctcggtcacttccg

SEQ ID NO: 302533 - DNA, 589 bp, Homo sapiens
  misc_feature: GZ8MTXP02GOY7C.52.78.H01.1.454.CMB.2.raw
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (399)..(399): a, c, t, g, unknown or other
  misc_feature (399)..(399): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattgtaccagcagngcaggccagcccctatgngatatataaggaccagtgagacggccctacgaggggactcccgtagagcgtattcctctggtctacctctcgagggaccaacgagtactacgttgatcatcagtgggagtacccgggngagacggacggaggacgtagtactagttactgtactaaactcaaacagacaagtaggttaggttacttaagtgtacgacgtacgggtttacggacggggtaagggaacccaaaggtcgtaccggtacccgtacgtaacgggtccaaccggacccgaaaggtccgtacccggtcccccggtacggtccccg

SEQ ID NO: 302534 - DNA, 559 bp, Homo sapiens
  misc_feature: GZ8MTXP02FH5U2.52.78.H01.1.454.CMB.2.raw
  modified_base (362)..(362): a, c, t, g, unknown or other
  misc_feature (362)..(362): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccacggcccccttattggtgatatataaggaccatgagaggcccctgagggactccctggagcgattctctcggctccctcctcagggaccaacncgtcaacgttgatcatcagtggacgtccgggacagaggacgaggctgactatactgtacaatacaacagacaggtagtcgtacttatgtgacgtagttcgggacgggacgggtaaccgagtacctacggacccgttaccgtacggtccaacggccccgaaaggccttaccgccccccgttacgggtccactttcccg

SEQ ID NO: 302535 - DNA, 622 bp, Homo sapiens
  misc_feature: GZ8MTXP02IJ36Y.52.78.H01.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtcctgacactctcctgtgtancctntggattcacctttaacagttatggatgacttggtccnccaggctcgagggaggctggagtgggngccgagcgtagagnagtgagtgggagtgaaggaagacgtagtcgggacgtacttcggtagtagggacgggtacctacttaccaaccgtacccgtttaccgaagaacgaaaccaaacacgttaacaaaacgtaactacgaattagtactactaaccaaagtcgagtaccacgtcctagacctacgccggaaagaccgaacggtccgttagttaacttacgttggacggtaccgtaaggtttagtttcggtttaagggtactttggtttcgtacggtttcgacctaacgtcg

SEQ ID NO: 302536 - DNA, 528 bp, Homo sapiens
  misc_feature: GZ8MTXP02HFB32.52.78.H01.1.454.CMB.2.raw
  modified_base (378)..(378): a, c, t, g, unknown or other
  misc_feature (378)..(378): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggcctcagggatccctgagcgattcctcgtggctcctctcagggacaacgagtcacgttgaactcatacngtggagtccgggcaggaggacgaaggcgtagactagttactgttacaatcgaaactagacagtagtggtacttatgtagcgtagttcggcggtaggaccaaagcgtcgaccgtcgtagtcacgccaacggctccgcccctacggtacccg

SEQ ID NO: 302537 - DNA, 547 bp, Homo sapiens
  misc_feature: GZ8MTXP02JHXAQ.52.78.H01.1.454.CMB.2.raw
  modified_base (391)..(391): a, c, t, g, unknown or other
  misc_feature (391)..(391): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttagtcggtgatatataaggaccatgagaggccctgagggatccctgagcgattcctctggcctcctcctcgagggacaacacgtcacgttgatcatcagtggacgtcggnaggagacgaggctgacgtattactgtacaatacaacagaacagtagtggtacttagtgtgacgtaggttcgggacgggtacgggaaccaaaggtcgtacgacccgtcgtaaggtccgacggacccaacgggtcctaccggtcccccgtggtacccc

SEQ ID NO: 302538 - DNA, 597 bp, Homo sapiens
  misc_feature: GZ8MTXP02JBKGR.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtgggggtccctgacactctctgtgtagcctctggattcacctttaacagttattggatgacgttgggtccgccaggcctccgaaggggaaggggctggaggtggggtggcccaggcgtgaaagtcagtgagtgggagtggaaggaagactaatggcggactcgtgtaggaagggccgattccacctacttaccaagtacgaacaaacactacaaacgtaactacaaattagtaactactaacctaaatgaacgacaacgcctagaacacgtaccggaagaacgaccggtcgttacgttattaccgtgttacgacgtagttacgtttgttgggtattggtttcgtcgtttcgaccgacgtcg

SEQ ID NO: 302539 - DNA, 559 bp, Homo sapiens
  misc_feature: GZ8MTXP02JVUTT.52.78.H01.1.454.CMB.2.raw
  modified_base (362)..(362): a, c, t, g, unknown or other
  misc_feature (362)..(362): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (550)..(550): a, c, t, g, unknown or other
  misc_feature (550)..(550): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccacggcccccttatcggtgatatataaggaccatgagaggccctgagggactccctgacgcgtattctctcggcctcctctcgagggacaacncgtcacgttgactcatacaggtggacgtccggggacaggaggaccggaggctaggaccttatacctgtacaatacaaacngaacaggtagtagtacttagtgtgactaggtcggnggtacggacgaagcgttacggaaccgtcgtacggtacacggaaccgaacggccgtaccgccccgtcggtaccncgtttcccg

SEQ ID NO: 302540 - DNA, 547 bp, Homo sapiens
  misc_feature: GZ8MTXP02HXYJA.52.78.H01.1.454.CMB.2.raw
  modified_base (221)..(221): a, c, t, g, unknown or other
  misc_feature (221)..(221): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcatgaccaaagcaatatggttattcggtacagcagaggccaggccacggccccttatggtgatatanaagacatgagaggcctagaggactccgtgagcgtactctcgtcggcctccctcctcgacggacaacncgtacacgttgatcagtcagtgacgccggganaggacggagaggctgaactattacgtgtaacaattacaaacgagaacgaggtacgtaggttaaactgtagtgacgtagttacggacgggtacggaccaaagtcgtacgaccgtctacgggtcacgccgtaagcgtcgccccgtcgacctaccgtccg

SEQ ID NO: 302541 - DNA, 703 bp, Homo sapiens
  misc_feature: GZ8MTXP02G96KU.52.78.H01.1.454.CMB.2.raw
  modified_base (306)..(306): a, c, t, g, unknown or other
  misc_feature (306)..(306): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggtttccttgttgctatttagaaggtgtccagtgtgaggcgcagctggtggagtcgtgggggaggcttggtccaggccgtggggggtccctgacactctcctgtgtagcctctggattcacctttaacagttatggatgacttgggtccnccaggctccgagggaggctggagtgggtggccagcgtgaagcatgacgtgggaggtgaggaagactagtggcggactcgtggtaggaaacggggcccgtaaatttccgaaccctacctttacccgaaggaacgaaacccaaaacgaacttaacccgaaaagtaaacccttactaaaagttacgttaaacttacccttaaaccctaaaaagttcgggaaaacggccctaaacggcccccttaaggaaacctaaccgttaccccggggaaaggacccgaaccggggtcccgttacggttaaatttaacccggttggtacggtaccggtaaacggttaccggttttcgtttaagggggttactttcgggtttcggttacgtttaccgacctaaccgtcgg

SEQ ID NO: 302542 - DNA, 621 bp, Homo sapiens
  misc_feature: GZ8MTXP02IUFYJ.52.78.H01.1.454.CMB.2.raw
  modified_base (282)..(282): a, c, t, g, unknown or other
  misc_feature (282)..(282): n is a, c, g, or t
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (469)..(469): a, c, t, g, unknown or other
  misc_feature (469)..(469): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagagcaggccacgccccttatggngatatataagacatgagacggcctcgaggactcccgtgacgcgtattctcgtcgcctcctctcgacggaccaacncgtcacgttagactcatcgagtaggacgtccggganaggacggacgagacgtgaacttattacgtgtactaagtacaaagtagacgtaggtacgtagttacttagtacggtntaccgtaggttacgggacgggtaaacgggaccgaaacggtccgtaacgggtaaacccgttccggttaaacggtaccgaacccggaaccccggaaacggggtccctaccccggtaccccccggttccgggttacccctaacccgtttccccgg

SEQ ID NO: 302543 - DNA, 557 bp, Homo sapiens
  misc_feature: GZ8MTXP02IS4N8.52.78.H01.1.454.CMB.2.raw
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (386)..(386): a, c, t, g, unknown or other
  misc_feature (386)..(386): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccagcccccttatggtaatanataaggaccatgagagccctnagggatccctgacgcgatctctggccctcctcctcacgggtacaacagtcacgttgatcaatcagtgagtccggnagaggagagctgactagtactgtacaaagctaaaccagacaggtagtagtaacttagttagtgtcgaggtttacgggacgggtacggggaacctaaaggcgttacggacccgtaccgtaggtaccacgacccgaaaggcctcgtacccccgtcggcctacgtccttccccg

SEQ ID NO: 302544 - DNA, 617 bp, Homo sapiens
  misc_feature: GZ8MTXP02HJWNM.52.78.H01.1.454.CMB.2.raw
  modified_base (200)..(200): a, c, t, g, unknown or other
  misc_feature (200)..(200): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgnagctggtggagtcgtgggggaggcttgggtccaggccgtggggggtccctgacactctcctgtgagcctcnggattcaacctttaaanagttatgatgacgtggccncgaggctacggagggaggcgtggaggtgggtgccgagcgtagaagnagtgagtggggagtggaaggaagactagtggacgactcgtggtaaggaacgggcctacttaccaacctacttacaaaggaacaactaaanaacaacaaagaaactaacaaatagtatactaactaaatagagacacgacgacgaacacgaccgaacggaacgaccggtaccggtacgttaattacgtacggtacggtacgtacgttacggtttacggtttaagggttaggttcggtttacggttcggttcgtaccgtaccgacg

SEQ ID NO: 302545 - DNA, 682 bp, Homo sapiens
  misc_feature: GZ8MTXP02JOMXL.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtgggtggaggtcgtggggggaggtcgttgggtccaggtcccggtgggggggtcccctggaccacctctcctggtgtacgccttctggacttccaacctttaacagtttattggatggtacgttcgggtccgccgaggcctccggaaggggaaggggctggggaggtggggtcggccgaggcgtagaaacgcaagtggagtgggaggtgaaagggaagtactagtcggacggtactcgtgtaggaaacggggccgtattcccaaccctacttcccgaagacgaaccaaacgtactaacgaaaagtaacctacgaaattgttaactacctaaccaaaagtcgacgacaacgcccgtaagactaacgtacccggaacggacccgaccgggtaccgttagttaacttaccggtagtcgggacgtaacggttaggttttcgttaaggggtacgttggtttcgtcgtttcgaccacgtccgg

SEQ ID NO: 302546 - DNA, 531 bp, Homo sapiens
  misc_feature: GZ8MTXP02JDS23.52.78.H01.1.454.CMB.2.raw
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattggtaccagcagagccaggccacggccccttatggtgatatataaggaccatgagaggccctcgagggactccccgtgacgcgtattccctctggctcctcctcgacgggaccaactacgtctacgttgactcatcagtggagtcgggcagaggacgagcgtagactattacngtacaatcaacagaacagtagtaggtacttatgtncgtagttcggcggacggacgaagcgtacgaccgtctaaggtcgacgccgaacgcctacgccccgtcgtaccc

SEQ ID NO: 302547 - DNA, 760 bp, Homo sapiens
  misc_feature: GZ8MTXP02IP3KM.52.78.H01.1.454.CMB.2.raw
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaacccagcaggacggccacggcccacggtcccccttagtttcgggtacgtaataataacgtaacggaacctatcgagacggcccctacgacgggactcccgtggagtcggtacttcctcgtcggtccttccctaccgtcgacgggtaacaaacgtacgttaccgtaacgtttacggaacttaccgaacgttacccgaaagggttcgggggtaaccggttaccccgggggacgtaaacggggaacgggggtaaccggaaacgggtcccgttacgggtaaaccctttagttaaaaccgttcggtttaaaccaaaactttaaccccgaaaacgtaaccggtaaacgttaaacgggttaacggttaagggtttaaccgtttaaacgttggttacggtaaccgttaaacgggtttccgggggaccgggttaaacggggaacccgtaaaacggtcccggtttaaacccgggg

SEQ ID NO: 302548 - DNA, 611 bp, Homo sapiens
  misc_feature: GZ8MTXP02JLYZN.52.78.H01.1.454.CMB.2.raw
  modified_base (315)..(315): a, c, t, g, unknown or other
  misc_feature (315)..(315): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatagtggttattggtaccagacagacggccacgtccacggtccccttagttggtanatatataaggaccagtgagacggccctacgagggactccctaggacgtcgatttcctcgtcggtccttccctccgtacgacgggaacaaaccgagttccgacgttgactcgactcgaggtcgggacgtacccggggcgaaggacgggaacggacggtacgtacggtaacttaagttaccgttagtactaatacaaacgagacaggttaacgtcggttattagtggtacgacgttacggttcggacgggtaacgggaaccgaacggtccgtacggtacccgttacgtaacggtcccg

SEQ ID NO: 302549 - DNA, 558 bp, Homo sapiens
  misc_feature: GZ8MTXP02IV7Q6.52.78.H01.1.454.CMB.2.raw
  modified_base (279)..(279): a, c, t, g, unknown or other
  misc_feature (279)..(279): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (448)..(448): a, c, t, g, unknown or other
  misc_feature (448)..(448): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagagcagccaggcccctatggnatatataagacatgagagcctgagggactcccgtgacgcgtatctcgtggcctcctcctcgagggacaacnggtacacgtagatcatcagtggngtccgganaggacggacgaggctagactaagtactgtacagtacaacgtagactagtagtcgtaattagtgtcgngtaggtcggagggtaacggacgacgtcgtacggaccgttaccgtaggtaccgaccggtaaccgaaacggtcccgtacccggtcccccgtaccggtacctaccctttcccg

SEQ ID NO: 302550 - DNA, 543 bp, Homo sapiens
  misc_feature: GZ8MTXP02H3C4W.52.78.H01.1.454.CMB.2.raw
  modified_base (223)..(223): a, c, t, g, unknown or other
  misc_feature (223)..(223): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
tcagcgcagtacgacacgaccggtgctcgatttagtgtgagtagtttgggtttgggggtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctgganatgcactgaccaaagcaatatggttatggtacagcagaggccaggccaggccccctatggtgatatataaggaccagtgagacggcctcgacggactccgtgagcgtatctctcggctcctccncgaggacaacncgtctacgttgatcatcaggtggagtccggcaggaggacgaggcctaggtactaattctagtacaatacaagacgaagagttagtagtacttaagtgtagtacgtagggtcggacggacggacgaaagtcgtacgaccgtcgtacgtacacgaaccgacgccgtccgacccgtcggctacgtccg

SEQ ID NO: 302551 - DNA, 554 bp, Homo sapiens
  misc_feature: GZ8MTXP02JTSTF.52.78.H01.1.454.CMB.2.raw
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacgccaggatcacctgctctggagatgcactgccaaagcaatatggttatggtaccagcagaggccaggccaggcccccttattcggtgatatataaggaccatgagaggccctnagggactccctgacgcgattcctcgtgctcctctcgagggacacagtcagtgatcatcagtggacgtccggcagaggacgaggctgactatacngtacatcatagacagtagtggtactagtgtagcgtaggttccgggcggtacggggacaaacgggtcctacgggtaacccgtccgtaacgggtccgaacggtacccccggaaaggtccgtacccgtcccccgttcgggtttacccc

SEQ ID NO: 302552 - DNA, 573 bp, Homo sapiens
  misc_feature: GZ8MTXP02GE39O.52.78.H01.1.454.CMB.2.raw
  modified_base (307)..(307): a, c, t, g, unknown or other
  misc_feature (307)..(307): n is a, c, g, or t
  modified_base (543)..(543): a, c, t, g, unknown or other
  misc_feature (543)..(543): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtccctgacactctcctgtgtgcctctggattcacctttaacagttatggatgacttgggtccncaggctccgagggaaggggctggagtgggtggccaggcgtgaagcatgagtggaggtgaaggaagactagtggcgactcgtgtggaaaggggccgaattccgacctaccttcccgaagagaacaaacactacaaagaactacaagttataactctaccaaaatgagcaacgcctagacatccggaggacacggtccgtagttattactggtcgacgtagtacgtttgttaagggtnttggtttcggtcgtttcgcgtaccgtacgg

SEQ ID NO: 302553 - DNA, 640 bp, Homo sapiens
  misc_feature: GZ8MTXP02FX2GG.52.78.H01.1.454.CMB.2.raw
  modified_base (305)..(305): a, c, t, g, unknown or other
  misc_feature (305)..(305): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagcttggtccagccgtggggggtccctgacactctcctgtgtagcctctggattcacctttaacagttatggatgacttgggtccnccaggctccgaggggaggggctggagtgggcggccagcggtgaagcatgagtgggaggtgaaggaagacttagtggccggactcgtgtagggaaacggggccgtattaccaccctaccttccgaaagacgaaaccaaacacgtacaaaacggtaacttacaaattcgtactacctaacccaaaagtcgaaagcaaacgtcccgtagaacctacgtaccggaaggaacccgaacggggtcccgttagttaaaccgttacgttcggtggaccgtaaggtccgtttttcggttaaggggtctttgggttttacgtcgggtttcgaccttaaccgtcgg

SEQ ID NO: 302554 - DNA, 625 bp, Homo sapiens
  misc_feature: GZ8MTXP02HBGVW.52.78.H01.1.454.CMB.2.raw
  modified_base (483)..(483): a, c, t, g, unknown or other
  misc_feature (483)..(483): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctatttagaaggtgtccagtgtgaggcgcagctggtggagtcgtgggggagcttggtccagccgtggggggtccctgacactctcctgtgtagcctcgtggattcctaacctttaacagttattggatgacgttgggtcccgcgtaggcctccggaaggggacggggctgggaggtggggtcggcccgaggcgtgaaagtcagtgacgtgggaggtagaggaagactagtcggcgtactcgtaggtaggaacggggccgtacttaccgaaccctaccttaccaaggacgaacaaactacacaaagtaacctaanaatagtactacctacaatgagacacgcacgactacgtaccggacggaccgaccggtacgtagttacgtacgtggtacggtacgtacggttgtttacggttaagggtacgtttcggttcgttaccggttacgacccgtacgcg

SEQ ID NO: 302555 - DNA, 600 bp, Homo sapiens
  misc_feature: GZ8MTXP02F4V4M.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacttgggccgcaggctccgaggggagggctggagtgggtggccagcgtgaagcagtgagtggagtgaggaagactagtgacggactcgtagtgaaacggggccgatttccaaccctacttccgaagacgaacaaacatacaaaagactacaaattgtaactctaaccaaatgacgacacgccctagaacctagtacccggaaggacccaacggggtcccgttagttaaatttaccgtggttcgacggtaaacgtggttttagtttgggggactttgggtttcgtacggtttcaccgaccgtcgg

SEQ ID NO: 302556 - DNA, 638 bp, Homo sapiens
  misc_feature: GZ8MTXP02F18PT.52.78.H01.1.454.CMB.2.raw
  modified_base (580)..(580): a, c, t, g, unknown or other
  misc_feature (580)..(580): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggaggcttggtccagccgtgggggactccctgacactctcctgtgtagcctctggattctacctttaacagttattggatgacgttcgggtccgccaggctccgaggggaaggggcgtgggaggtggggtggccgaggcgtgaagcatgagtgggaggtggaaggaagactagtcggacggtacttcgtggtaggaaacggggtcccgtaattcccaaaccctacttacccgaagaacgaaccaaactataacaaacgtaaactacaaattgttaactacctaacaaaatggaaacgccaaggccctaggaaacctagtacccggaaggacccgaacggtcccggttagttactttacggngtacgacggtagttacgtttcggttagggtactttcggttggtcgttcgaccgtaccg

SEQ ID NO: 302557 - DNA, 706 bp, Homo sapiens
  misc_feature: GZ8MTXP02I3Q0D.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagacgcaggccacggccccttagtggtagatatagtaaaggaccagtagaggacggccctacgagggtactccctgacgcgtattcccgtcgtcggccttccctcctacgaacgggacaacgtacgtaccgtacgttcgaatacctagttaccgaggtacggtacgggtacccggggacgaagggaaacgggaccggaagggccttaaggtaaccttaagtttaaacccgtgttaaaccaaagttacaaaaccgtaggtaaaccgtaaggttaacgttaggttaaccgttaaagtcggtagtaccgtaagggtttcccggggacgggaaacgggacccgtaaaggttccggtaccggtaaaaccccggttccgttaaacgggtaaccgtaaacccggacccggtaaacggccccgttaacccggtcccccgtcgggtttaccccc

SEQ ID NO: 302558 - DNA, 556 bp, Homo sapiens
  misc_feature: GZ8MTXP02GZMM9.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtaccagcagacggccaggccacggtcccccttagtggtagatatataaggacatgagaggcctgagggatcccgtgagcgtattccgctgctcctctcagggacacacgtcacgttgatcatacagtggacgtcggacgagagacgagcgtagacttatactgactaatacaatacgaagagtagtaggtacttaagtgtacgtactaggttaccgggacggaacgggaacgaacgtaccgtacggaacccgttcgtaacggtcgaacggaccgtaaacgcgtacccgccccgtcggtaccc

SEQ ID NO: 302559 - DNA, 579 bp, Homo sapiens
  misc_feature: GZ8MTXP02HWVY1.52.78.H01.1.454.CMB.2.raw
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (528)..(528): a, c, t, g, unknown or other
  misc_feature (528)..(528): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctgacactctcctgtgtancctctggattcacctttaacagttatggatgacgttgggtccnccaggcctccgaggggaaggggctgggaggtggggtggccaggcgtagaagcagtgagtgggaggtgaaggaagacttagtggacgggactcgtggtaggaacggggccgtattcccaaccctacttcccgaagacgaacaaacatacaaaagaactacaaatgtaatcctacaaaatgagcagcctagacatccggagacacggcttagtacttacngtcgacgtagtacgttcgtttaagggatttggttcgtcgttcgctaccgag

SEQ ID NO: 302560 - DNA, 518 bp, Homo sapiens
  misc_feature: GZ8MTXP02GQXOD.52.78.H01.1.454.CMB.2.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtaccagcagagcaggcacgcccctatgnatatanaagacatgagnggccctgaggactccctgagcgattcctcgtggctcctcctcgaacgggacaaacgagtcgacgttgatcatcaggtggagccgganagaggacgaggcngaactattacngtnaaactcaaacagacaagtagtacggtattagtgtgcaggtcggacggaggaaccgaagcgtgaccgtctaggtaacacgcccgaagcctcgccccctcggtacc

SEQ ID NO: 302561 - DNA, 502 bp, Homo sapiens
  misc_feature: GZ8MTXP02HMR98.52.78.H01.1.454.CMB.2.raw
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (498)..(498): a, c, t, g, unknown or other
  misc_feature (498)..(498): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagaggccaggccaggccccctattggtgatatataaggaccatgagaggccctcagggatccctgagcgattctcncggctcctcctcagggacaangtcaacgtgatcatcagtggagtccggcagaggacgngcngactagttacngtacaatcaaacagacagtagtgtattangtncagttcggacggacggacaagctacgaccgttcacggtcagcccaaggctcgccctcgtcnctcg

SEQ ID NO: 302562 - DNA, 521 bp, Homo sapiens
  misc_feature: GZ8MTXP02IQ6G8.52.78.H01.1.454.CMB.2.raw
  modified_base (261)..(261): a, c, t, g, unknown or other
  misc_feature (261)..(261): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (496)..(496): a, c, t, g, unknown or other
  misc_feature (496)..(496): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagngcaggcaggccccttatgtgatatataaggacatgagacggcctgagggatccctgagcgattctctcggcctccgtctcgagggaccaacagtcacgttgatcatcagnggagtcggcagnggagngcngactatactgtacaatacaacagactagtaagttggacttagtgtgcgtaggtcggaggacggaccaagcgtacgaccgtcgttaacggcacgcccgaaaggccncgcccccgtcggtaccacgttcccg

SEQ ID NO: 302563 - DNA, 736 bp, Homo sapiens
  misc_feature: GZ8MTXP02JE216.52.78.H01.1.454.CMB.2.raw
  modified_base (243)..(243): a, c, t, g, unknown or other
  misc_feature (243)..(243): n is a, c, g, or t
tcagcgcagtacgacacgaccggtgctcgatttagtgtgagtagtttgggtttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatntggttattggtaccagcagaggccaggccacggcccccttagttcggtgatatataaaggaccagtgagtaacggccctacgaggggactcccgtagacgcgtattcccgtctcggtccttccctccgttaccgacggggacctaaacgtacggtaccgtaccgtttagaacttccaagttccgaggttcggtaacggtaccggggcgaaagggacggaccgggaggtacccgtagggaactttaacgtttaacgtacggttaactaaactaccgtaaacgaacggtaaccgtaaagggtttaagttacgggtttaaacgtttaacgttaaggtcgtacgttaacgggtttaccggggacggggttaacggggaacccgtaaacggtccggtaccggtaacccggttaccggtttaaacgggtaaccgtaaaccggaccccggtaaaacggggtaccgttaccccggtaccccccggttcgggtttaaacccc

SEQ ID NO: 302564 - DNA, 541 bp, Homo sapiens
  misc_feature: GZ8MTXP02FWY7U.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttatggatgacttgggtccgccaggctccgagggaaggggctggagtgggtgccagcgtgaagcatgatggagtgaggaagactatgcggactctgtgaaggggccgattcaccacttcccagagacaacatacaaagaactacaatgtaatctaccaaatcgaagcacgcctagacagtccggagacgacggccgttgtacttacgtgtgcgtagtagtttcgttggggattggttcgtcgttggcctaccgtag

SEQ ID NO: 302565 - DNA, 588 bp, Homo sapiens
  misc_feature: GZ8MTXP02FVCEN.52.78.H01.1.454.CMB.2.raw
  modified_base (291)..(291): a, c, t, g, unknown or other
  misc_feature (291)..(291): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccaggccccttatggtgatanataaggacatgagacggccctgagggactccctgagcgtattcctcgtgctcctcctcgaacgggacaaacgagtcgtaaccgttgactcattcaggttggacgtccgggacaggaggaccgtaaggctagaactattacgtgtacaatcaacagaacagtagtagttactaagtgtagcgtaggttaccgggacggacgggtaaccaaaggccgttacgggtaaccccgtcgttaacgggtccaacgggaccccaaacgggcccgtttcccggaccccccgtttacggttaccccg

SEQ ID NO: 302566 - DNA, 673 bp, Homo sapiens
  misc_feature: GZ8MTXP02HF27I.52.78.H01.1.454.CMB.2.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctggtggagtcgtgggggagcttggtccagccgtgggggtccctgacnctctctgtgtagcctntggnttcacttaacagttatggatgtacttgggtccgccgaggcctaccgagggggaacggggcgttaggggaggttggggtcggcccgaggcggtaggaaagcaagtggagtggggaggtaggaaggaaagacgttagtcggacggtacttcggtagtaggaaacggggccgtacttaccgaaccctacgttcccaaagggactaaaccaaactactaccaaaagtaaaccctacaagttacgtaactacctaacaaagtacgacgaccacgtcctagaactacgtaacccggaaggtaccgtaccggtcgttagttaacgtttacgacggttacggtacggtacggtttacggtttacgtttaagggtacgtttcggtttcggttcgttacgaccgtaccgtcg

SEQ ID NO: 302567 - DNA, 598 bp, Homo sapiens
  misc_feature: GZ8MTXP02HKVX3.52.78.H01.1.454.CMB.2.raw
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccagccgtgggggtccctgacactctcctgtgtagcctctggattcacctttaacagttattggatgacttgggtccnccaggcctccgagggaaggggctggagtggggtgccgaggcgtgaagcatgatggagtgaaggaagactagnggcggactcgtgtagggaacgggccgtaattccaaccgaccttaccgagaacgaacaaacactacaaagactacaagtatataccttacaaaagtcgagacagtaccctagaacagtaccgacggacgaacgggtccgttagttaattaccgtaggtcgacgtaggttaacgtttcgttgggtaacttggtttacgtcggtttcggaccttaccgacg

SEQ ID NO: 302568 - DNA, 640 bp, Homo sapiens
  misc_feature: GZ8MTXP02FK7L8.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttatggtgatatataaggaccatgagaggccctcgagggactccctgagcgattctctcggctcctcgtaaggacaacgagtcgacgtagtatcgatacgacgtggacggtccgggacgacggaagggaacggacgggtacgtacggtaacttaacgttacgtacgttacgtaaagttaccaaaaccgaagaaccgtaaggttaaagggttaggttaaccgtttagttaggttcggtacgtaggttacggggtacggggaacgggaaaccggaacggacgtacggacccggttaccgtacggtacgaccgacccgaaacggccgtaccgcccccgtccggtccgaccgtcgtttcccccgg

SEQ ID NO: 302569 - DNA, 561 bp, Homo sapiens
  misc_feature: GZ8MTXP02HWJF8.52.78.H01.1.454.CMB.2.raw
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (417)..(417): a, c, t, g, unknown or other
  misc_feature (417)..(417): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggttttctgttagctatttagaaggtgtccagtgtgaggcgcagctggtggagtctgggggagcttggtccagcctggggggtccctggacactctcctgtgtagcctctggattcacctttaacagctattggatgacttggccgcaggctcagggagggctggagtgggtgccagcgtgaagcatgntgaggngaggaagatagtgcggacgtctgtgagggaccggacttacaccacttccagagacaacaacacaanaactactaatagtactactactaaatagagacgacgactacgacgacgtacgacggaaccgacggtacgtacgtacgttacgtacgtacgtacgtagtacggttcggttacggttacgttcggttcggttcgttcgtacgtacg

SEQ ID NO: 302570 - DNA, 575 bp, Homo sapiens
  misc_feature: GZ8MTXP02HF965.52.78.H01.1.454.CMB.2.raw
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacgccaggatcacctgctctggagatgcactgaccaaagcaatatggttattggtaccagcagaggccaggccacggcccccttatcggtgatatataaggaccatgagacggccctgagggactcccgtgacgcgtattctctcggcctccctcctcagggtaacaacngtacacgttgatcatcagtggacgtcggacaggaggacgaggctacgactagttactaggttacaaattaccaaaacgacgaaccgtacggttaagtacggttaacttaacgtggtacgccgtaggttaccggggacgggtaacgggacccgaaggtcctaaccggg

SEQ ID NO: 302571 - DNA, 523 bp, Homo sapiens
  misc_feature: GZ8MTXP02FFPIR.52.78.H01.1.454.CMB.2.raw
  modified_base (226)..(226): a, c, t, g, unknown or other
  misc_feature (226)..(226): n is a, c, g, or t
  modified_base (391)..(391): a, c, t, g, unknown or other
  misc_feature (391)..(391): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctgganatgcactgacccaaagcaaatatggttattggtaccagcagaggccaggccaggcccccttatggtgatatataaggaccatgagaggccctcgaggggatcccgtgagcgattcctctggctcctcctcagggcaacatcacgttgatcatcagtggagtcggnagagacgaggctgactatactgacaatcaacagacagtagtaggtacttagngtgcgaggttcggacggtagggaccaaaggctacgaccgtccgtaggtccgagacccaaggcctacgccccctggtaccc

SEQ ID NO: 302572 - DNA, 777 bp, Homo sapiens
  misc_feature: GZ8MTXP02JWY69.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagttggtgatatataaggaccatgagacggccctgagggactcccgtgagcgtattccctcgtcggtcctccctccgtacgaacggggtacaaacgtacggtaccgtacgttaggaacttacgagttaccgtagggtacggggtacgggtacccgggggacgaaggggaacggggacggggaacgggtcgttacgggtaaaccttaacgtttaaccgttacggttaaccgtaaactttaccgaaaacccggttaaaggtaaacccgttaaaggtttacgggtttaagggttaaaccgttttaacgttggggtttacggtaccggttaaacgggggttttccgggggtaacgggggtaaacgggggtaaacccggaaaacggttccggtaaccggtaaccccggttaccggttaaccggggttaaccgtaaccggaaccccggtaaacggggtacccgtacccggtacccccccggttcggtttaacccccgg

SEQ ID NO: 302573 - DNA, 696 bp, Homo sapiens
  misc_feature: GZ8MTXP02GLKZK.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctctggagatgcactgaccaaagcaatagtaggttattggtaccagcagaggccaggccacgccccttagtggtagaatataagtaaggaccagtgagacgccctagagggactcccgtagacgtcgtattctcgtcggtccttccctaccgtacgaacgggtaaccaaacgtcgtaccctaggttagactacctaagtaccgtaggtacggggtaaacgtcccggggacgaaagggacggtaacgggaacggtcgtaacggtaacgtttaaacttacgtacgtaaacctaaaactaaccgaaaagacgtaaccgttaaaggtacggttaagttaaccgttaagttggtgacgttaacggggtcgggaacgggaacgggtaaccaaacgggtcgtacggtaccgttaccggttacgggtaccaaccggggaacctaacgggtccgttacccgcccccgtttacggccttaccgtttccccg

SEQ ID NO: 302574 - DNA, 544 bp, Homo sapiens
  misc_feature: GZ8MTXP02F9638.52.78.H01.1.454.CMB.2.raw
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (454)..(454): a, c, t, g, unknown or other
  misc_feature (454)..(454): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggcaggccaggcccccttatcggtgatatataaggaccatgagaggccctcgaggggatccctgagcggattcctctggctcctcctcgacgggcaacngtcaccgttgatcatcagtggagtcggnagaggacgaggcngactattactgtanaactgaactagacaagtagtagttacttagtgtgntacggttcggacgggacgggacaaaggcgtacgaacccgtccgttacggcgacggacccgaacggcgttaccggccccgtcggttacccg

SEQ ID NO: 302575 - DNA, 689 bp, Homo sapiens
  misc_feature: GZ8MTXP02G55XR.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgccaaagcaatatggttattggtaccagcagagccaggccagcccctatggtgatatataaggaccatgagacggcctcgaggactcccgtagacgcgtattccctcgtcggcctccctcctcgacggggacaacgtacgtacgaccgttgaactactactcgtagggtcggtacggtccggggccgaagggagggaaccgggcgggtacgtacgggtaacttaacgtttaaacgtgggttaacctaaacggttaacaaacccgaaggtaacccgtaaacggttaggttaacggttaaaccgtttagttaccggttaggacgttacgggttacgggaccggggaaggggttaaccgaacggaaccgttcggtaacccggtacccggtttacgggtaaccgtaaccgggacccgaaaacgggtccccgtaccgggaccccccttacggggttacccccg

SEQ ID NO: 302576 - DNA, 538 bp, Homo sapiens
  misc_feature: GZ8MTXP02JSTY8.52.78.H01.1.454.CMB.2.raw
  modified_base (372)..(372): a, c, t, g, unknown or other
  misc_feature (372)..(372): n is a, c, g, or t
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
tcagcgcagtacgacacgaccggtgctcgatttagtgtgagtagtttgggtttggggaggtctcggagaggagccttagccctggattccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagcctggggggtccctgacactctcctgtgtagcctctggattcacctttaacagttattggatgacttgggtccgccaggctccgaggggaaggggctggagtggggtggccgaggcgtgaagcatgatggagtgagganactagtgcggactcgtgtggaagggccgtattccgaccacttcccagacgaacaaacatacgaaagaactcaaatcgtatcctacaaatgagcagcctagacagtccgagacacggcctgtatacngtcgcgagtagttcgtggacttgtacgtcgtgctaccgng

SEQ ID NO: 302577 - DNA, 519 bp, Homo sapiens
  misc_feature: GZ8MTXP02IG475.52.78.H01.1.454.CMB.2.raw
  modified_base (257)..(257): a, c, t, g, unknown or other
  misc_feature (257)..(257): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtacngcagagcaggccaggcccctatgtgatatataagacatgagaggccctacgagggactcccgtagacgcgtattcctctggctcctcctcgacgggtacaacagtctacgttgatcatcagtggagtcgggcagaggacgagcagactattacgtgtacaatcaacagacagtagtaggtacttatgtgcgtagttcggacggaggaccaaagcgttacgaccgtctaacggtcgaacgccgaacggctcgcccctcggtcc

SEQ ID NO: 302578 - DNA, 507 bp, Homo sapiens
  misc_feature: GZ8MTXP02GGA1Q.52.78.H01.1.454.CMB.2.raw
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagcgcagtacgacacgaccggtgctcgatttagtgtgagtagtttgggttggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgaccaaagcaatatggtattggtaccagcagagcaggccaggcccccttatggtgatatataaggaccatgagaggccctcaggatccctgagcgatcctctgctcctcctcagggcaacagtcacgttgatcatcagtggagtccgggnagaggacgaggctgactattactgcaatcaanagacagtagtaggtacttaagngttgacgagttccggaggagggacctaaagctgaccgtcctaggtcacgcccaaggctcgcccccgtcggtacc

SEQ ID NO: 302579 - DNA, 530 bp, Homo sapiens
  misc_feature: GZ8MTXP02FK990.52.78.H01.1.454.CMB.2.raw
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcaggccaggccccttatggtgatatataaggcatgagaggcctgagggatcccgtgagcgtattcctctcggctcctcctcgaacgggacaacgagtctacgttgatacatcaggtggacgtcgggacagaggacgaggctgactatatganatacaacagacagtagtagtactatgtancgtaggttcggacgggaggaacgaagcgtacggtacccgtcgtaacgggcacgcccgaacgtcgtaccgccccgtcggtaccc

SEQ ID NO: 302580 - DNA, 621 bp, Homo sapiens
  misc_feature: GZ8MTXP02IP8ZY.52.78.H01.1.454.CMB.2.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatgttatggtaccagcagagcagccagcccctatgngatatataaggacatgagacggcctcgagggactcccgtagagcgatttccctcgtcggtcctccctccgttaccgacggggaccaaacgtagtacctacgttagactacaataccgtaggtagggtacggtcccggggacgaaggaacgggacggaacggtcgtacggtacttaacgttacggtgttaaccaacgttacaaaccgaggaacctaaggttaagttagggttaacttagttgtagtacgtaggttccgggagggtaacggggaccaaaggtacgtacgacccgtcgtaggtaaccgacgacccgaacggcctccgcccccgttacggtaccc

SEQ ID NO: 302581 - DNA, 624 bp, Homo sapiens
  misc_feature: GZ8MTXP02GX9DS.52.78.H01.1.454.CMB.2.raw
  modified_base (360)..(360): a, c, t, g, unknown or other
  misc_feature (360)..(360): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttatggtaccagcagagcagcacgcccctatgtgatatataaggacatgagacggcctcgagggactcccgtagagcgattctctggctccctccncgtacgggacaacagtactacgttagatacattccaagttgggaacgtccggggcaaagggacgggaacggacggtaccgtagggtaaccttaagtttaaacccgttgttaacgaaaacgttaccaaaaccgtaagaaaccgtaaagttacgggttaacgggttactttaaacgttggttaccggtagtaacgggtttccggggacggggtaacgggaaaccgaaacggtccgtacggtacccggttaccgtacggtaacccgg

SEQ ID NO: 302582 - DNA, 693 bp, Homo sapiens
  misc_feature: GZ8MTXP02J36T7.52.78.H01.1.454.CMB.2.raw
  modified_base (246)..(246): a, c, t, g, unknown or other
  misc_feature (246)..(246): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaattntgtttatgtaccagcaggagccaggccacgtccccttagttggtagatataagtaaggaccatgagacggccctagaggtactcccgtgacgcgtacttcctcgtcggtcctcctccgtacgacggggaccaaacgtacgttacctaccgtttagactacgtacttaccgaggttcggggacggtcccgggggacgaaggaacggggacgtaggtcgttacgggtaactttaacgttacttagttaaccaaattaccgaaacgaacggtaaccgtaagggttaaccggttagggttaacctttaaaggttcgtacggtaccgtaaacggggtttccgggacgggtaacgggaaaccgaaacggtcgtaccgggtacccgttaccggttacggtaaccgacccgacccgtaaccggtccgtccccggtcccccgttcggtttaccccc

SEQ ID NO: 302583 - DNA, 606 bp, Homo sapiens
  misc_feature: GZ8MTXP02IUJC5.52.78.H01.1.454.CMB.2.raw
  modified_base (552)..(552): a, c, t, g, unknown or other
  misc_feature (552)..(552): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggtttccttgttgctattttagaaggtgtccagtgtgaggcgcagctggtggagtcgtgggggagcttggtccagccgtgggggtccctgacactctcctgtgtagcctctggattcacctttaacagttatggatgacgttgggtccgcaggctccgaggggaaggggctggaggtggggtggccaggcgtagaaagcagtgagtgggaggtgaaggaagactagtggcggaactcgtggtggaaacggggcctaagttcccaaccctacttcccgaaagacgaacaaacatacgaaagtaaacctacaaagttcgtaacttcctaacaaaagtcgagacaacggccctagaacctacgtacccgaaggaccaacgggtccgtagttacttacgngttcgcgtagtagtttcggttaagggactttggttcgtcgttcgactaaccgcg

SEQ ID NO: 302584 - DNA, 641 bp, Homo sapiens
  misc_feature: GZ8MTXP02FRHVC.52.78.H01.1.454.CMB.2.raw
  modified_base (502)..(502): a, c, t, g, unknown or other
  misc_feature (502)..(502): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagctgggttttccttgttgctattttagaaggtgtccagtgtgaggcgcagctggtggagtcgtgggggagcttggtccagccgtgggggtccctgacactctcctgtgtacgcctcgtggattcacctttaacatttatggatcgacttgggtccgccgaggcctccgaggggaaggggctaggaggtggggtcggcccaggtcgtggaagcagtggacgtggggaaggtaggaacggaaagtacgttagtgggacgggacttcgtagtagggaaacggggcccgtaattacccaacccgtaaccttacccgaaaggacgtaaacaacaatacaaaacgtacacaaagttntaactcctaaccaaagtgaaagcacgtcctagaactcggacccggaagtaccgaacggtccgttagttaacttacgtggtacgacggtaagttcggtttgtttaaggggcttggtttcgtccggttcgacctcgtaccg

SEQ ID NO: 302585 - DNA, 662 bp, Homo sapiens
  misc_feature: GZ8MTXP02ITILS.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagcccaccctcggtgtcagtgtcctcaggacagacggccaggatcacctgctctggagatgcactgaccaaagcaatatggttattggtaccagcagacgccgacggccacggcccccttagttggtcgtatataagtaacggaccagtagagacggccctaccgacggggactcccgtgacgacgtattccgtcgtcggcctcccgtccctacgaacggggacaaacgtgtacgtacgttagactactatcgaggttagggacgtccgggacgaggtaacgggaccggaaggtctacgggtacttaacgtttacgtaggtaacaacgttaacgaaacgacgtaaacgtaggttaaggttacggtttaaaccgtttacgttacgggttgtaacgggttacgggtttaccggggacgggttaacggggtaaccgacggttaccggtacggtaacccggttaccggtaacggtaacccgg

SEQ ID NO: 302586 - DNA, 565 bp, Homo sapiens
  misc_feature: GZ8MTXP02JDCVO.52.78.H01.1.454.CMB.2.raw
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccacggcccccttagttcggtgatatataaggaccatgagaggccctgagggactcccgtagacgcgtattctcgtcggcctcctctcgaggacacngtctacgtgatcatcgaaggtgacggtccggacgaggaggacgaggtcagtacttagtacgtgtacaatacaacgtagacagttagtaggtacttntgtgcgtagttcggacggacggaccgaagccgtacggtaccgtccgtaggtccaacgaaccggtaaacgccgtccggacccccgttcggtcctaccgtttcccg

SEQ ID NO: 302587 - DNA, 602 bp, Homo sapiens
  misc_feature: GZ8MTXP02H13OY.52.78.H01.1.454.CMB.2.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccagatcacctgctctggagatgcactgaccaaagcaatatggttatggtaccagcagagccaggccaggccccctatcggtgatatataaggacctatgagaggccctgaggatccctgagacgattctntcggctcctctccaggggtaccaacngtacgtacgttacgatcctatccaggttggacgtccggggcaacgggaggacgtagggcgtaggaaccttaagttaccgttagtacaaattaccaaacgacgaaacgtaggtaggttagggttaaccttaagttggttacggacgtacggttcgggacgggtacgggaaccgaggacgtacggaccgttacgtacggtacgacgaacccgaaggtctaccggcccctacgggtccacgttcccg

SEQ ID NO: 302588 - DNA, 558 bp, Homo sapiens
  misc_feature: GZ8MTXP02JBXQH.52.78.H01.1.454.CMB.2.raw
  modified_base (246)..(246): a, c, t, g, unknown or other
  misc_feature (246)..(246): n is a, c, g, or t
  modified_base (291)..(291): a, c, t, g, unknown or other
  misc_feature (291)..(291): n is a, c, g, or t
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatntggttattggtaccagcagaggccaggccacggtccccttatggngatatataaggaccatgagagccctcgagggactcccgtgagcgtattcctcgtcgctcctcctacgaggaccaactagtcctacgttgactcatcagtggacgtcgganagaggacgaggctgactattactgtacaatnaacgagaactagtagttaggttacttagaggtgacgtggttcggacgggacgggtaacccgaagtccgtacggacccgtacgttacggaacgacgacccgaaggcctccggcccccgtacggtccc

SEQ ID NO: 302589 - DNA, 560 bp, Homo sapiens
  misc_feature: GZ8MTXP02I1Q4V.52.78.H01.1.454.CMB.2.raw
  modified_base (382)..(382): a, c, t, g, unknown or other
  misc_feature (382)..(382): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctgggcctcctatgaactgacacagcccaccctcggtgtcagtgtcctcaggacagacggccaggatcacctgctctggagatgcactgaccaagcaatatgttatggtacagcagagcagccacgtccccttagttcggtgacgtatataaggaccatgtagacggccctcgaggactccgtgacgcgattcctctcggcctcctcctcgaggacaacgngtcagtgactcatcgagtggacggtccggcgacggaggaccggagtcgtagacttagtaccgtagtacaattccaaagagaacgtagtaagttacggtatttagtgtcgtacgtacggtttacggggacggtaacggaaccgtaggtaccgtacgtaccggttaccgtacggtacccg

SEQ ID NO: 302590 - DNA, 565 bp, Homo sapiens
  misc_feature: GZ8MTXP02HHEIY.52.78.H01.1.454.CMB.2.raw
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccacggcccccttagttggtagatatataaggaccatgagaggccctcgagggactcccgtgacgcgtattcgtcgtcggcctcctctcgaggacaacngtctacgttgatcatcgaggtggacgtccggganagggaggacgaggctagaactatactgtacaatacaagagactaggtagtggttacttagtgtgacgtaggttcgggacggtacgggaaccgagcgtacggaccgttacgtacggtccgacggaacccgaagggcctcggtccccgtcggtcctacgtttcccg

SEQ ID NO: 302591 - DNA, 575 bp, Homo sapiens
  misc_feature: GZ8MTXP02JNM7Q.52.78.H01.1.454.CMB.2.raw
  modified_base (309)..(309): a, c, t, g, unknown or other
  misc_feature (309)..(309): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctgacactctcctgtgtagcctctggattcacctttaacagttatggatgacttgggtccnccaggctccgagggagggctggagtgggtgccagcgtgaagcatgatggagtgaggagactatggcgactcgtgtagaacgggccgattccgacctacttccagacgaacaacatacaaagaactacaaatgtatctacaaatgaagcagccctagacacgtaccggaaggacaccgggtaccgttagtacttaacgtggttagccgtaaagtcggtttcgtttgggggaactttggtttcgtccggtttgacctaacccgtacgg

SEQ ID NO: 302592 - DNA, 585 bp, Homo sapiens
  misc_feature: GZ8MTXP02IBKYS.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccacggccccttatgtgatatataaggacatgagacggccctgagggactccctggacgacgtattccctcgtcggtcctcctctccgacgggacaacgtagtcctaccgtttagactacatcgtaggtggtacggtccgggacgaggaacggggacggaagggtccgtagtacgttaattaccgttgtacaatacaactagacagtagtagtacttagtgtgcgtaggttcgggacggtacgggaacaacggctacggccgttaccgacggtaaccgacggaccgacggcctcccggtaccccgtacggtcccg

SEQ ID NO: 302593 - DNA, 667 bp, Homo sapiens
  misc_feature: GZ8MTXP02FQOOJ.52.78.H01.1.454.CMB.2.raw
  modified_base (270)..(270): a, c, t, g, unknown or other
  misc_feature (270)..(270): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacactctctgtgtgcctctgnttcacctttaacagttatggatgtacgttcgggtcccgaccgaggcctccggaaggggaaggggcgtagggaggtggggtcggcccgaggcggtagaagcagtgagtgggaggtaggaaggaagactagtcggcggtactcgtagtaggaaacgggcctagttccacccgtaaccttccgaaagaacgaaccaaaacataacaaaacgtaacctaacaaacgttagtaactacctaaacctaaaagtcgtaacggaccaacgtacccgtacgaacgtacctaccgggaaggaacccggaccggtacgttagttaacttaccggttgtacgtacgtaaggttacgttttcggtttaagggtagtttggtttcggtcgtttccgaccgtacgtaaccgg

SEQ ID NO: 302594 - DNA, 550 bp, Homo sapiens
  misc_feature: GZ8MTXP02GADF8.52.78.H01.1.454.CMB.2.raw
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggccaggccccttatggtgatatataaggaccatgagaggccctcgagggactccctgacgcgattctctcggcctcctcctcgagggaccaacngtcacgttgatcatcagtggagtcccgggnaggaggacgaggctagactattacngtacaatcaacagacagtagtgtacttagtgtgcaggttcggacggtacgggacccaggtaccgtacggacccgtaccgttacgtccgacgaacccgaaacggtcctcgtcccccgtcggtaccctactttccccg

SEQ ID NO: 302595 - DNA, 621 bp, Homo sapiens
  misc_feature: GZ8MTXP02FYCL0.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgtactgaccaaagcaattatggttattggtaccagcagagcaggccacgccccttatggtgatataataaggacatgagaggccctgagggactcccgtgagtcgtattctcgtcggccccttccctcctacgaacgggaaccaaacgacgtcctaacggttgaacttacgattcgaaggttgggaacggttcccggggacgaagggaacgggaacggaggtaccgtagtaacttaacgtttactagtacaaatacgaaacagaacagttagtacgttaagttagtagtcgtacgtacggttacgggacggaacggaacgaaggcgtacggaccgttccgtaacgtacgacgaccgaacgtccgtcccgacccgtccggtacaccgtctttaccccg

SEQ ID NO: 302596 - DNA, 593 bp, Homo sapiens
  misc_feature: GZ8MTXP02H9P2X.52.78.H01.1.454.CMB.2.raw
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactcgaccaaagacaatagtggttattggtaccagcagaggccaggccacggtccccttagttcggtgaatatagtaacggaccagtagagacggccctgagggactccgngacgcgtattccctcgtcggtcctcctcgtacgacgggacaaacgtacgtcgtaccgtttgacttcaacgtcgtaggcggtacgtcccgggganacgggaaggaccggaggtacgtagaccttaattaccgtgttacaagtacaaacagtacaggtagttacgtattagtgtgtacgaggttcgggacggagggaacaaggcgtacgaccgtacgacgtcgacgaccgtacgccttcccgccccgtgtaccc

SEQ ID NO: 302597 - DNA, 551 bp, Homo sapiens
  misc_feature: GZ8MTXP02GHLY6.52.78.H01.1.454.CMB.2.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatggttattggtaccagcagaggccaggccacggccccttatgngatatataaggaccatgagacggccctgagggactccctgagcgattctctcggcctcctcctcgagggaccaacngtcacgttgatcatcagtggcgtaccgggnaggaggacgagctagactattactgtacaatacaacagacaggtagtgttacttagtgtagctagggtcgacgggacggaccgaaggcgtacggtacccgtcgtacggtacgacgaacccgtaaggccttcccggccccctcggtaccctacgtttccccg

SEQ ID NO: 302598 - DNA, 540 bp, Homo sapiens
  misc_feature: GZ8MTXP02JCBBZ.52.78.H01.1.454.CMB.2.raw
  modified_base (307)..(307): a, c, t, g, unknown or other
  misc_feature (307)..(307): n is a, c, g, or t
  modified_base (426)..(426): a, c, t, g, unknown or other
  misc_feature (426)..(426): n is a, c, g, or t
  modified_base (496)..(496): a, c, t, g, unknown or other
  misc_feature (496)..(496): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagccgtggggggtccctgacactctcctgtgtagcctctggattcacctttaacagttattggatgacttgggtccnccaggctccgagggagggctggagtgggtggccagcgtgaagcatgatggaggtgaggaagactatggcggactctggtggaaaggggccattccaccgacttccaagacgaacaaacntacaaagaactacaaatgtaatctacaaatcgagcacgcctgacacgtcgagacacggctagtattacgngtacgcgaagtgttcgttgggattggttcgtcgttgcctacacg

SEQ ID NO: 302599 - DNA, 550 bp, Homo sapiens
  misc_feature: GZ8MTXP02GDND2.52.78.H01.1.454.CMB.2.raw
  modified_base (396)..(396): a, c, t, g, unknown or other
  misc_feature (396)..(396): n is a, c, g, or t
  modified_base (458)..(458): a, c, t, g, unknown or other
  misc_feature (458)..(458): n is a, c, g, or t
  modified_base (490)..(490): a, c, t, g, unknown or other
  misc_feature (490)..(490): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggccccttattggtgatatataaggaccagtgagacggcctacgagggactcccgtgagcgtattcctctggcctcccttccncgaacgggacaaacgacgtcgtacgttcgatcattcgagtaggcgtccgggcaggaggacgngactgacttatactagtacaatacaacacganacgtaaagtggtacttagtcgttgcgtacgttcgggacggacggaccgaagtcgtaccgg

SEQ ID NO: 302600 - DNA, 699 bp, Homo sapiens
  misc_feature: GZ8MTXP02G84B5.52.78.H01.1.454.CMB.2.raw
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcggtgggggaggtcttggtccaggccgtgggggtccctgacnctctctgtgtgcctctggattcaccttaacagttatgatgtacgttgggtccncgaggcctaccggaaggggaggggctgggaggtggggtcggccaggcgtgaaacgcagtggagtgggaggtaggaacggaagtactagcgggacgtactcggtagtagggaacgggaccgtattacccaacccgtaccttccgaagaacgaacaaatacgaacaaacgaactacaaagtacgttaactacctaacctaaaagtcgaacggacctacgtacccgtaacgtaaccgtaccgtacccggaaagggtaccccgaaaccggggttcccggttagtttaaccgtttacggtacgggttacgtccggtaaaaggtttcgtttaccgggttttaagggggtactttagggttttcggttacgtttcggaccctaaacccggtaccgg

SEQ ID NO: 302601 - DNA, 594 bp, Homo sapiens
  misc_feature: GZ8MTXP02F6QQQ.52.78.H01.1.454.CMB.2.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttatggtacagnagaggcagcacgcccctatgngatatataagacatgagagccctagaggactcccgtgacgcgattcgtctcggtcctcctcctcgaggacaacngtacacgttgatcatcaacggtgacgtccggacaggaggacggagctagactaagtacgtagtacaaactaacgaaacgagaaacgtaagtaaggttacggttaagttaagttggtaagtccggtaaagggtttcggggaacgggaacgggtaccgaaaggtcgtacggaccgttaccggtacgtccgaaccgaacccgaacggtacgtcccgtcccccggtacggtacctacggttccccg

SEQ ID NO: 302602 - DNA, 598 bp, Homo sapiens
  misc_feature: GZ8MTXP02I9E3M.52.78.H01.1.454.CMB.2.raw
  modified_base (376)..(376): a, c, t, g, unknown or other
  misc_feature (376)..(376): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagcttggtccaggccgtggggggtccctgacactctcctgtgtagcctctggattcacctttaacagttattggatgacgttgggtcccgccaggctccgaggggaagggctggagtggggtggccagcgtagaagcatggatgggagtgacggganactagtggcgactctggtacggaaggggtcccgaattcccaccctacttaccgagaacgaaccaaacataacaaagtaactacaagtagtatacctacaaaatcgagaccaacgccctagactaacgtcccgaaggaccgtaccggaccgttagttaaacctttggacgtgtaccgtaagtgtttcggttaaggtgtttgttcggtcgtttcgctaacgtcg

SEQ ID NO: 302603 - DNA, 633 bp, Homo sapiens
  misc_feature: GZ8MTXP02JWGJ3.52.78.H01.1.454.CMB.2.raw
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttaattggtaccagcagagccaggccacggcccccttatggtagatataataaggaccatgagacggccctcgacgggactcccgtgacgcgattctctcggtcctcctcctcgacgggacaacgngtaccacgttagactcatcgaggtggacggtcccggngaaggagggaacggacggtcgtaggtaacttagttactgtaactaatacaacgagactagggttaagtggttaactttagtggtacgacgttacggggttcgggacgggtacgggaacccgtaggtaccgtcgggtaacccgtccgtaacgggttacgaccgggtaaccccgaaacgggcccgttaacccggtcccccgtacgggttcccaaccgtttcccccgg

SEQ ID NO: 302604 - DNA, 575 bp, Homo sapiens
  misc_feature: GZ8MTXP02F6ANA.52.78.H01.1.454.CMB.2.raw
  modified_base (224)..(224): a, c, t, g, unknown or other
  misc_feature (224)..(224): n is a, c, g, or t
  modified_base (314)..(314): a, c, t, g, unknown or other
  misc_feature (314)..(314): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctgganatgcactgaccaaagcaatatggtattggtacagcagagccaggccacggcccccttattggtgatatataaggacagtgagaggccctnacgggactcccgtagagcgtattcccgtcgtcggtcctcctccgtacgacggggacaacacgtctacgttgatccattaccgaggttacggacggtccggggacagggaacggccgtaagggccttaggaccttaattacgtacgtacaatacgaacaagactaagtagtagtacttagacgtgtcgtaggtcggacggagggtaccaaagcgtacgaccgtcgtaagcgacgacccgaggtcctacgccccgttggaccc

SEQ ID NO: 302605 - DNA, 571 bp, Homo sapiens
  misc_feature: GZ8MTXP02HJSJY.52.78.H01.1.454.CMB.2.raw
  modified_base (188)..(188): a, c, t, g, unknown or other
  misc_feature (188)..(188): n is a, c, g, or t
  modified_base (359)..(359): a, c, t, g, unknown or other
  misc_feature (359)..(359): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctcggtgtcagtttcctnaggacagacgccaggatcacctgctctggagatgcactgaccaaagcaatatggttatggtaccagcagaggccaggccacggccccttatcggtgatatataagaccatgagacggcctgagggactccctgagcgtattctcgtgcccctcctctcgacgggtacaacngtcacgttgatcaatcgagtcgggacgtccggagagacgggacggaggcgttaggaaccttagtacgttgactaaagactaaacagtaactaggtaggtagttacttaagtgtacgataggttcgggaggaacgggtaccaaggcgtacgaccgtcgtacggtacgaacgcccgaaggccttccgccccgtcggtccacgttccgttccccg

SEQ ID NO: 302606 - DNA, 827 bp, Homo sapiens
  misc_feature: GZ8MTXP02JVQ57.52.78.H01.1.454.CMB.2.raw
  modified_base (227)..(227): a, c, t, g, unknown or other
  misc_feature (227)..(227): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatccacctgctcgtgganatgcactgaccaaagcaattagtaggttagttacggtaccagacaggacggccgacggcccgacggtccccttagttcggtagtatataagtaacggaccagtggagacggccctacggacggtacctcccgtagacggtaccgtatttccccgtacgtcggtcccttccctccgtaccggaacggggaccaaacgtacgtaccgtaacggttgaactctacgtcgtagggtacgggtaaccgggtccgggaggaacgggacggggacggacggggtacttaggtacctttaacgttaccgttggttaaaaccaaagttaaccgaaacgtaacgggtaaaccgttaaaggttacggggtttaacggttaaacgttttaaggtcgggtttaacgtaccgggggtttaaaacgggggttcccggggtaaacgggggaaaccgggggtaaccccgtaaacggggtaccccgtttaccggggtaaaacccccggggttcccggtttaaaccggggtaacccgaaaacccggggtaccccccgttaaacgggggttacccccgtccccccggttaaccccccggtttccggtttaacccccccgg

SEQ ID NO: 302607 - DNA, 572 bp, Homo sapiens
  misc_feature: GZ8MTXP02JMOZ2.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggccccttatggtgatatataaggaccatggagacggccctcgagggactccccgtagacgcgatttccctcgtgcttcctcctcgaggggacaacgagtcacgttgatacatcaggtggacgtccgggcagaggacgaggtctagacgtattacgtgactaactacaaacgagaacagtaagttggttacttatgtgtactagggttacggacgggaagggacgaacgcgtacgacccggttccgtaaacgggtcgacggacccaagggtcctcccggtcccccgtacggttccc

SEQ ID NO: 302608 - DNA, 502 bp, Homo sapiens
  misc_feature: GZ8MTXP02I7ZF2.52.78.H01.1.454.CMB.2.raw
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacgccaggatcacctgctctggagatgcactgccaaagcaatatggttatggtacagcagagcagccaggcccctatgngatatataaggacatgagaggcctcgaggatccctgacgngatctctggctcctcctcaggacaacngtcacgttgatcatcgagtgagtcccggnacggagacgagcngactatacngtacatcaactagacagtagtggtatntagtgntagtcgcggaggacaagcgtacgaccgtcgtaaggtccaggtaacccgaaggctaccgccctcggtccacttccg

SEQ ID NO: 302609 - DNA, 684 bp, Homo sapiens
  misc_feature: GZ8MTXP02GND14.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaacatggagttggggctgagctgggttttccttgttgctattttagaaggtgtccagtgtgaggcgcagcgtggtggagtcgtgggggaggtcgttggtccaggccgtgggggtccctgacactctcctgtgtacgcctctggtacttcacctttaacagtttattggatgtacgttcgggtcccgccgaggcctccggaggggaaggggcgtggaggtgggtcggccaggcgtagaagcagtgagtggaggtaggaaggaagtactagtcgggaccgtacttcgtaggtacgggaacggggtccgtaactttacccgaacccttaccgttacccgaaagaacgaaacctaaacacttaaccgaaaacgtaacctactaaagttcgttaaactacctaacctaaaagtgaacgacgacgtacctagaacacgtaccggaaggtaccgacggtaccgtagttaacgtttacgtggtacgaccggtagttaacggtttttcggttaaggggtacttttgggtttacgttcggtttacgacccgtaaccgtcgg

SEQ ID NO: 302610 - DNA, 622 bp, Homo sapiens
  misc_feature: GZ8MTXP02IL74A.52.78.H01.1.454.CMB.2.raw
  modified_base (225)..(225): a, c, t, g, unknown or other
  misc_feature (225)..(225): n is a, c, g, or t
tcagcgcagtacgacacgaccggtgctcgatttagtgtgagtagttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatccacctgctcgtgganatgcactgaccaaagcaatattggttattggtacagcagaggccaggccacgccccttagtggtgatatataagaccatgagacggccctacgacgggactccccgtagacgacgtagttcctcgtcggccttcctccctacgaacggacctactacgtaccgtaacgttgacttacaacgtcgtagtggacgtaccgggacgaaggacggacggaggcgtaggaacttacgttacgtacgtactaaactacgaaaccgaaggtaaacctaggttaaggttaggttacgtttaagtgtaagtcgtaaggttcgggacggtaggaccgaaggcgtacgacccgttacgtaacggtaaccgacgaccgtaacggtcgtcccgtaccccgtacgtacccg

SEQ ID NO: 302611 - DNA, 642 bp, Homo sapiens
  misc_feature: GZ8MTXP02HNA44.52.78.H01.1.454.CMB.2.raw
  modified_base (331)..(331): a, c, t, g, unknown or other
  misc_feature (331)..(331): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagcccaccctcggtgtcagtgtcctcaggacagacggccaggatcacctgctctggagatgcactgaccaaagcaatattggttatggtaccagcagaggccaggccacggtcccccttagttggtgatatataaggaccagtagagacgccctcgaggactcccgngagacgtattcctcgtcggtcctcctcctcgacggaccaacgcgtctacgttagtactactactacgaggtcggacgtcccgggacgaggacgggacgagggcgtagtacttattacgtagtactaaagtaccaaacgtaagtaacgtagggtaagtttacggtaactttaagtggtacgacggttacggttcggggacgggtacgggaaccgtaggtaccgtcggtacccgttaccgtacggtaaccgaccggttaacccggaacggcccgtacccggtcccccgtcggtaccctacccgtttacccccg

SEQ ID NO: 302612 - DNA, 621 bp, Homo sapiens
  misc_feature: GZ8MTXP02J00U0.52.78.H01.1.454.CMB.2.raw
  modified_base (337)..(337): a, c, t, g, unknown or other
  misc_feature (337)..(337): n is a, c, g, or t
  modified_base (390)..(390): a, c, t, g, unknown or other
  misc_feature (390)..(390): n is a, c, g, or t
  modified_base (606)..(606): a, c, t, g, unknown or other
  misc_feature (606)..(606): n is a, c, g, or t
tcagcgcagtacgacacgaccggtgctcgatttagtgtgagtagtttgggtttggggaggtctcggagaggagccttagccctggactccaaggcctttccacttggtgatcagcactgaacacagaggactcaccatggagttgggctgagctgggttttccttgttgctattttagaaggtgtccagtgtgaggcgcagctggtggagtcgtgggggaggcttggtccagccgtgggggtccctgacactctctgtgtagcctctggattcacctttaacagttattggatgacgttggccgccaggctccgaggggaggggctggaggtggggngccaggcgtgagcatgatgggaggtgaggaagactagtcgcggactcgtaggnggaacggggcctaacttccaccctaccgttcccgaagaacgaaccaaacataaccaaaggtaacctacaaattgtacttaccctaaccaaaagtcgaaagtcccgaagtaccctagaacccagtaccccggaagggacccaccggggtccgttagtattacgtggtacgacggtagtacgttttcgttaggggtaatttcggttagttccggttcncccgtaacgcgtccg

SEQ ID NO: 302613 - DNA, 578 bp, Homo sapiens
  misc_feature: GZ8MTXP02GLXJ2.52.78.H01.1.454.CMB.2.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactccctgcacaggctctggggcctcctatgaactgacacagcccaccctcggtgtcagtgtcctcaggacagacggccaggatcacctgctctggagatgcactgaccaaaagcaattagtggttattggacagcagagccgagccaggccccttntggtgatatataaggacatgagaggccctacgaggactccctgacgngtattctcgtcggcctcctcctgaggacaacagtcacgttanatcatcagtggacgcgagaggacggagagtcagtactatactagtacactacaaagacgagtagtaggtagttactagtgtacgtacgtacggtacgggacggaacggacctaacggccgtacggtacccggttacgaccgtaccgaccggacccgaacggtcccgtcccgtacccccggtacgtaccctaccgtcccgtttacccg

SEQ ID NO: 302614 - DNA, 601 bp, Homo sapiens
  misc_feature: GZ8MTXP02GOYVM.52.78.H01.1.454.CMB.2.raw
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcaactgaccaaagcaatatggttatggtaccagcagagcagccacgcccctatgngatatataagacatgagacgcctcgaggtactccgtgacgcgtatcgtctcggtcctcctcctacgacgggaacaacgngtacacgttacgatcatccgagtacggacggtcccgggagagggaggaccggaaggccgtaggtacttagttacgtacgttacaagttaccgaacgtacgaacgtaagtagttagttaacttagtggtagcgtaggttcgggaggaacgggaccaaaggtccgtacggtaccgttacgacggttccacggtaacccgaacggtaccgtcccggtacccccgtcggtaccctaccgtttccccg

SEQ ID NO: 302615 - DNA, 556 bp, Homo sapiens
  misc_feature: GZ8MTXP02IK29U.52.78.H01.1.454.CMB.2.raw
  modified_base (285)..(285): a, c, t, g, unknown or other
  misc_feature (285)..(285): n is a, c, g, or t
  modified_base (363)..(363): a, c, t, g, unknown or other
  misc_feature (363)..(363): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagcccaccctcggtgtcagtgtcctcaggacagacggccaggatcacctgctctggagatgcactgaccaaagcaatagtggttattcggtacagcagagccagccaggccccctattggngatatataaggacatgagacggcctgagggactcccgtgagcgattctctcggtcctcctcctacgacgggacaacgngtcaacgttgactcatcaggtgacgtcggcgagaggacgaggctnacgtattacngtacaagtacaacgtagacgtagtagtaggttacttaagtgtcgcgtaaggttcggacgggtacggacgtaaaggctacggaaccgtcgtaacgtcacgtaacccgaggtctaccgccccgtcggtacctacgttccc

SEQ ID NO: 302616 - DNA, 511 bp, Homo sapiens
  misc_feature: GZ8MTXP02IF825.52.78.H01.1.454.CMB.2.raw
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (509)..(509): a, c, t, g, unknown or other
  misc_feature (509)..(509): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggagcttggtccagcctggggggtccctgacactctcctgtgtagcctctggattcaccttaacagttattggatgacttgggtccnccaggctccgagggagggctggagtgggtgccagcgtgaagcatgatggagtgaggaagatatgcgatctgtgaagggcatcaccattcagaganaacatacaagaactanatatatacacaatgananacgcanacacacgacgacgacgacgtagtatactagtcgcgtacgtagttgttggtagtgttcgtcgtcgtacacncg

SEQ ID NO: 302617 - DNA, 598 bp, Homo sapiens
  misc_feature: GZ8MTXP02IPM8Z.52.78.H01.1.454.CMB.2.raw
  modified_base (254)..(254): a, c, t, g, unknown or other
  misc_feature (254)..(254): n is a, c, g, or t
  modified_base (376)..(376): a, c, t, g, unknown or other
  misc_feature (376)..(376): n is a, c, g, or t
  modified_base (456)..(456): a, c, t, g, unknown or other
  misc_feature (456)..(456): n is a, c, g, or t
  modified_base (567)..(567): a, c, t, g, unknown or other
  misc_feature (567)..(567): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctgggtggaggtcgtgggggaggcttggtccagccgtgggggtccctgacnctctcctgtgtagcctctggattcacctttaacagttattggatgacttgggtccgccaggctccgagggaggggctggagtggggtggccgaggcgtgaagcatgagtggaggtgaggaanacgtatggcgactcgtgtggaagggcgtattccaccgacttccaagacgaaccaacacgtacaaacgaaactacaaattntacttctaaccctaaatcgagcaacgcctagaacacgtcccggaaggacccgaacgggtccgtagtttaacttaccgtaggtcgtacgtaacggttgtttggtttaagggntttgggtttcgtcggtttcaccgtaacgtcg

SEQ ID NO: 302618 - DNA, 631 bp, Homo sapiens
  misc_feature: GZ8MTXP02ISH6C.52.78.H01.1.454.CMB.2.raw
  modified_base (308)..(308): a, c, t, g, unknown or other
  misc_feature (308)..(308): n is a, c, g, or t
  modified_base (457)..(457): a, c, t, g, unknown or other
  misc_feature (457)..(457): n is a, c, g, or t
  modified_base (507)..(507): a, c, t, g, unknown or other
  misc_feature (507)..(507): n is a, c, g, or t
  modified_base (627)..(627): a, c, t, g, unknown or other
  misc_feature (627)..(627): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtccctgacactctcctgtgtagcctctggattcacctttaacagttatggatgacttcgggccnccgaggctccggaggggaaggggctgggaggtggggtcggacccgaggcggtagaaagcagtggagtgggaggtggaacggaagactagtggacggtactcgtagtaggaacggggcctattccaaccctacgtccaagacgaaccaanactacaaaagtacctagaaattcgtactacctaacgtaaaatcgggaacncgaacgtccaggaaccacgtcccggaaaggacccgacgggtcccgttagttaacttacgtggtaggccgtaaagtttcgtttcggttaagggtactttggtttcgccgttgacccctaanccgg

SEQ ID NO: 302619 - DNA, 692 bp, Homo sapiens
  misc_feature: GZ8MTXP02G77CT.52.78.H01.1.454.CMB.2.raw
  modified_base (256)..(256): a, c, t, g, unknown or other
  misc_feature (256)..(256): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggagtcgtgggggaggcttggtccaggccgtggggggtccctgacnctctcctgtgtagcctctggattctacctttaacagttatggatgtacgttgggtccgccgaggcctccggaggggaacggggctaggggaggttggggtcggcccgaggcggtaggaagcgtagtggagtgggaggtaggaaggaagtacgtagtcggacgtacgtcgtggtacgggacgggccgtacttacccaccgtaccttaccgaagaacgaacaaactactaacgaaaacgtaactactaagttacttactaccgtaacaaagtcggaacgaccacgtaccgtacgaacgtacggtaccggaacggaaccgtaccggtaccggttaaggttaactttaccggtaggttacggtacggttaaggtttaccggttttacggttggggttagtttcggggtttacgttcggttacggaccctaaccggtccgg

SEQ ID NO: 302620 - DNA, 590 bp, Homo sapiens
  misc_feature: GZ8MTXP02I5W5L.52.78.H01.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (414)..(414): a, c, t, g, unknown or other
  misc_feature (414)..(414): n is a, c, g, or t
  modified_base (450)..(450): a, c, t, g, unknown or other
  misc_feature (450)..(450): n is a, c, g, or t
  modified_base (517)..(517): a, c, t, g, unknown or other
  misc_feature (517)..(517): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtagcctctggattcacttacagttattggatgacttgggtccgccaggctccgaggggaaggggctggagtggggtgccaggcgtagancatgatggagtgaggagctanggcgactcgtgtgaagggctattccacctactcagacgacaacntacaaagacacaatgtactcctaccgaaatcggaanccaacgcccgtagaaccgtactacccggaaggaccgtacccgggccgtttagttaaacgtttaccgngggtacccgcgggtaaagttcggttttccggtttaagggatttcggtttgttccggttcgaccgtaacgtcgg

SEQ ID NO: 302621 - DNA, 604 bp, Homo sapiens
  misc_feature: GZ8MTXP02HSELR.52.78.H01.1.454.CMB.2.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctggacactctcctgtgtgcctntggattcaccttaacngttatggatgacttgggtccncaggctaccgaggggaaggggctggaggtgggtcggcaggcgtaggaagcagtgagtgggagtgaggaanactatcggcgtactcgtggtacggaaacggggcctagttcccacgtacctccaaggactaacaaccataccaaaagtacctanaaatgtaactccacctaaaagngagccaagtccagacacgtaccggaagaccgaccggtcgttagttacttacgtggtacgacggtagtttacggtttggtttaaggggtacttggtttcggttacgtccgacctaacgtcgg

SEQ ID NO: 302622 - DNA, 576 bp, Homo sapiens
  misc_feature: GZ8MTXP02HET1U.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcacctgctctggagatgcactgaccaaagcaatatggttatcggtacagcagagcagccacggccccttatggtgatatataagacagtgagacgcctgaggactcccgtgacgcgtattcgtctcggtcctcctcctcgaacgggaccaacgcgtactacgttgactctatcgaggtaggacggtccgggacgaggacggacggagtcgtagtaactatacgtgtacaatacaacagacaggttagtaggtacttagtgtgtcgtacggttcgggacggaacgggtaacaggtcgtacggtaccgttacgtacgggtacaccggaaccgaacggccgtcccgccccgtcggtacctaccgttcccg

SEQ ID NO: 302623 - DNA, 668 bp, Homo sapiens
  misc_feature: GZ8MTXP02GU1O5.52.78.H01.1.454.CMB.2.raw
  modified_base (325)..(325): a, c, t, g, unknown or other
  misc_feature (325)..(325): n is a, c, g, or t
  modified_base (401)..(401): a, c, t, g, unknown or other
  misc_feature (401)..(401): n is a, c, g, or t
  modified_base (478)..(478): a, c, t, g, unknown or other
  misc_feature (478)..(478): n is a, c, g, or t
  modified_base (526)..(526): a, c, t, g, unknown or other
  misc_feature (526)..(526): n is a, c, g, or t
  modified_base (655)..(655): a, c, t, g, unknown or other
  misc_feature (655)..(655): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagcgtggtggaggtcgtgggggagtcgttggtccagtccggtcgggggtccctgactctctcctgtgtagcctcgtggacttcaacctttaacagtttattggatggtaccgttcggggtcccnccgaaggtcctaccggaggggaggggtctgggaggtgggtcgccaggcgtagaagcatgagtgggaggtgaagganactagtcggcgtactcgtaggtagggaacggggtcctaacttcccgaaccttacgtacccaaagggacaaaccaaanactacgaaaactaaccttagaaacttgtaaactcctaaacgtaaaagngaacgccacgtaccgacgacgtacgaccggaacggtaccgtaccggttacgttacgttaaacgtcggtcggtacggtaacgttacgtttacggttttacggttaaggtcgttttcggttcgtcgttacncccggtaacgtcg

SEQ ID NO: 302624 - DNA, 534 bp, Homo sapiens
  misc_feature: GZ8MTXP02FROBJ.52.78.H01.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagagccaggccacggtccccttagtcgngatatataagacntgagacggccctgaggactcctgacgcgtatctctcggcctcccttcncgaggacaactgtcacgttagactcgatcgaggttgacgtccgggacaggacgacgagctagacgtatacgtnacagacaananagagtagtagtattagtgtgtgtagtcggacggacggacgacgacgtacgtacgtacgtacgtacgacgaacgacgaccgtccgtcccgtccgtacctactccg

SEQ ID NO: 302625 - DNA, 718 bp, Homo sapiens
  misc_feature: GZ8MTXP02GU596.52.78.H01.1.454.CMB.2.raw
  modified_base (169)..(169): a, c, t, g, unknown or other
  misc_feature (169)..(169): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacngccaccctcggtgtcagtgtcctcaggacagacggccaggatcacctgctctggagatgcactgaccaaagcaatagtggttatggtaccagcagagcagccacgccccttatcggtgatatataaggaccatgagtacggccctcggagggactcccgtagacgcgtaattcccgtctcggtcctcctccgtaccgaacggggaccaacgagtaccgtacgttagactcgtactacgtagttacggacgggttacccggggacgaggggaacgggacgggacgggtacgtacgggtaaaccgttaatttaaccgttaggttaaaccgtaaacgttaacaaacccgtaaagggaaacctaacgggttaaacgttaggggtttaaccttaggtttaacggtggacgttaaacggggtttccggggacggggtaaacggggaccccgttaaaaggaccgttccgggtaaacccgttcccgttaaacggtccgtaacccggacccgtaaaccggaccgtaccccggttcccccgtaccggggtttacccccg

SEQ ID NO: 302626 - DNA, 652 bp, Homo sapiens
  misc_feature: GZ8MTXP02JR6ME.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaatatggttatgtaccagcagacggcaggctacggccccttattggtgatatagtaagaccagtgagacggcctcgaggactccgtgacgcgtatcgtctcggtcctcctccgtacgacggggtaaccaacgagttacctacgttagacgtccaatcctagggtagggacggtccgggaccgaagggacgggaacggacggtacgtacggaacttaacgtttacgtacgttaactaaagttaaccaaacgtaaaggaaccttaagggtaagttacgggttaatttagtggtacgtacggtaggttacgggacggggacgggaccgaaaggtcgtacggaccggttccgtaacggtcgaaccggtaaccgaacggtccgtcccggtccccggtaccggtctaccctttacccgg

SEQ ID NO: 302627 - DNA, 564 bp, Homo sapiens
  misc_feature: GZ8MTXP02JRK1H.52.78.H01.1.454.CMB.2.raw
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
tcagcgcagtacgacacgaccggtgctcgatttagtgtgagtagttgggtttgggggctgtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaaagcaaatatggttattggtaccagcagaggcagccaggcccctatgtnatatataagaccatgacgaggccctgaggatcctgngcattcctctggctcctctcagggacaaacagtccaagttgaacttcatanagtaggacggtcggcgagaggacgacggacgtagtactaacttactagtactaactaacaaacaagaacgtaagtaagtaggttagttagtagtagtacgtacggttacgggtacgggtaacgggtaacgaaacgacgtacgtaccgtacgtacgtaacgacgaccgaacgtacgtaccgtcccgtaccgtcg

SEQ ID NO: 302628 - DNA, 569 bp, Homo sapiens
  misc_feature: GZ8MTXP02GDN0H.52.78.H01.1.454.CMB.2.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
  modified_base (496)..(496): a, c, t, g, unknown or other
  misc_feature (496)..(496): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagccgtggggggtccctgacactctcctgtgtagcctctggattcacctttaacagttattggatgacttgggtccgcnggctccgagggaggctggagtgggtggccagcgtgaagcatgatggagtgacgaagctagtgcgactcgtgtgaagggccgnttaccacctacttccgaggacaacgaacactcgaaagaacctacaaagtgttaactcctaaccaaaatgaacggccagcccttagacacgtcccgaaggaaaccncggtacccgtgttaattaccgtgcggacgtagagttttcgtggggattggtttcgtcgttggacctacgtacg

SEQ ID NO: 302629 - DNA, 537 bp, Homo sapiens
  misc_feature: GZ8MTXP02F6Q1F.52.78.H01.1.454.CMB.2.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (348)..(348): a, c, t, g, unknown or other
  misc_feature (348)..(348): n is a, c, g, or t
  modified_base (528)..(528): a, c, t, g, unknown or other
  misc_feature (528)..(528): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatgtacagcagngcagcacgcccctatgngatatataagacagtgagacgccctgaggactcccgtgagcgtattctctcggcctcctctcgaggacaacngtcacgtgatcatcgaggtgacggtcccggagaagagggacgagccgtagacttatacgtgtacaatacaaacgtagaactaggtagtagtacttaagtcgtagcgtaggtcgggaggacggacgaagtcgacgacgtcgacggtcacgaaccgacgccgttccgaccccgtcggtaccncgtttcccg

SEQ ID NO: 302630 - DNA, 594 bp, Homo sapiens
  misc_feature: GZ8MTXP02GU3I5.52.78.H01.1.454.CMB.2.raw
  modified_base (449)..(449): a, c, t, g, unknown or other
  misc_feature (449)..(449): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagcccaccctcggtgtcagtgtcctcaggacagacggccaggatcacctgctctggagatgcactcgaccaaagcaaatagtggttatggtaccagcagacgccaggccacggtccccttagttggtcgaattataataacggacctagtagaggacggccctacgaggtactcccgtggacgcgtacttcctcgtggtccttccctcctcggacgggaaccaaactcgtaccgtacgttgactcatcgaggtgacggtccgganagggacggaaggacgacgtacggtaactattaacgtggttaacaacttacgaaacgagtactaaggtacggttaggttattaagtcgtagtacgtacggtccgggaggaacgggtaacacgtcgtacgaccgtcgttacgaccgg

SEQ ID NO: 302631 - DNA, 782 bp, Homo sapiens
  misc_feature: GZ8MTXP02FVCR2.52.78.H01.1.454.CMB.2.raw
  modified_base (310)..(310): a, c, t, g, unknown or other
  misc_feature (310)..(310): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctgacactctcctgtgtagcctctggtattcacctttaacagttatggatgacttgggtccnccaggctcgaggggagggctggagtggggtgccaggcgtgaagcagtgatgggagtgacggaagactagtggcggtactcgtaggtaggaaacggggcccgtattacccgaaccctaccgtttacccgaaagggaaacgaaacccaaaactacgtaaaccgaaaacggtaaacccttaacgaaaatttacgggttaaaacttaccccttaaaccccgtaaaaagttcgggaaaaccgggtacccaaacggtcccccgtttaaggaaacccgttaacggttacccccggggaaaagggggaacccccgtaaccgggggttaccccggtttagggtttaaaacctttaccgggtagggttacggtacccggggtaaaagggtttaccggtttttccggggttttaaggggggtaacttttcgggggttttacggttacccggttttccggaacccgttaaaccccggttccggg

SEQ ID NO: 302632 - DNA, 561 bp, Homo sapiens
  misc_feature: GZ8MTXP02G38EF.52.78.H01.1.454.CMB.2.raw
  modified_base (422)..(422): a, c, t, g, unknown or other
  misc_feature (422)..(422): n is a, c, g, or t
  modified_base (544)..(544): a, c, t, g, unknown or other
  misc_feature (544)..(544): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggcccccttagttggtgatatataaggaccagtagagacggccctacgagggactccccgtagagacgtattccctcgtggtctccctctcgagggaccaacgacgtacgtacgtgtactcacttcgaggtcggacggtcccggggnaagggacggacgaggctagactattactgtacatacaacagacagtagtagtaacttagtgtagcgtaggttcggacggaggtaccgaagtcgtacgccgtacgaggtcacgaccgaagtcnccggccccctggtaccc

SEQ ID NO: 302633 - DNA, 573 bp, Homo sapiens
  misc_feature: GZ8MTXP02FJD64.52.78.H01.1.454.CMB.2.raw
  modified_base (306)..(306): a, c, t, g, unknown or other
  misc_feature (306)..(306): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggagcttggtccagccgtgggggtccctgacactctcctgtgtagcctctggattcacctttaacagttatggatgacttgggtccncaggctcgagggagggctggagtgggtgcagcgtgagcagtgagtgggaggtgaggaagactagtggcgactcgtagtaggaaacggggcctagtttccaaccctaccttcccgaagacgaacaaacactacaaagaactacaatcgtaatctaccaaaatgagacaacgctagaacacgtccggaaggaccgaccggccgtagttaattacgtggtagccgtaagtagtttcgttaaggggattggttcgtcgttgacctaccgag

SEQ ID NO: 302634 - DNA, 640 bp, Homo sapiens
  misc_feature: GZ8MTXP02JI9PT.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttagtcggtgatatataaggaccatgagaggcctacgaggactccgtgagcgtatcctctcgctcctcctcgagggacaacagtcacgttgatacatcagtggaggtaccgggcgaggacgggacggacggcgtagaccgtttagttacgtcggttaacaaacgttacgaaaacgacgtaaacgaagttaacggttaggttaaaccgtttaagtggttactaccggtaagggtttaccggggacgggggtaaacgggtacccgaaaagggtccgttaacggacccggttccgtaaacggttccggtaaccgacccggaaacgggtaccgtcccgggtcccccgtaacgggttaccccg

SEQ ID NO: 302635 - DNA, 684 bp, Homo sapiens
  misc_feature: GZ8MTXP02GQR4A.52.78.H01.1.454.CMB.2.raw
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtgganatgcactgaccaaagcaatagtgttattgacngcagagcagccncgccccttagtgtgatatataagacatgagacgcctagaggactccgtgacgtcgtattccctcgtcggccttcctacgtccgaacgggtaccaaaccgtacggtaccgtaaccgttagtaacgtacgtaacgtacgtacggtaagggttaccggggtaccggacggtaacggggaaacggggtaccggaacgggtacgttacggtaaactttaacgttaccgtacggtaaactaacttaaccgaaaacgtaagaaccgtaaaggtaggtttacggtaacgtttaagtggtacgtaggtaccggtttacggggacgggaaacggtaacccggtaaagtcctaacggtacccggtacgttacggaaccgaccgaccggtaacgtccgtcccggtacccccgtcggtttaaccccg

SEQ ID NO: 302636 - DNA, 566 bp, Homo sapiens
  misc_feature: GZ8MTXP02HSRBA.52.78.H01.1.454.CMB.2.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgaccaaagcaaatatggttattggtacagcagaggccaggccacggcccccttagttcggtagatataataaggaccatgagaggccctagaggactccctgagcgacttcctctcggctccgtcctaccgaggggaccaacgtaggtacctacgttgacttcaatcgagtcggagtccgggnaggaggacgaggcngtactattactgtanaatacaacagaacagtagtacggtatagtgtgacgtaggttcggacgggaggaaccaaggtctacggacccgttacgaggtaaccgacggaccgtaacggcgcccgtccccgtacggtccc

SEQ ID NO: 302637 - DNA, 593 bp, Homo sapiens
  misc_feature: GZ8MTXP02G1LDM.52.78.H01.1.454.CMB.2.raw
  modified_base (386)..(386): a, c, t, g, unknown or other
  misc_feature (386)..(386): n is a, c, g, or t
tcagcgcagtacgacacgaccggtgctcgatttagtgtgagtagtttgggtttgggggtgggtccaggagtcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttattggtacagcagagccagccacggccccttatggtagatatataagacatgagacggcctacgaggactcccgtgacgcgtattctcgtccggccttccctccgtacgaacgggtaaccaacgtacgtactacggttanactacctagtaccgtaagggtcgggtaacggtcccggggagaacggggacggacgggaaggtccgtaggtacttaagttactagtacaaatacaacgtagacgtaggtagtacggttattagtcgtagcgtaggtcggacgggaacgacgagcgtacgacgtcgtaacgcgacgaaccgtaacgcctaccgcccgtcgtcacgttcc

SEQ ID NO: 302638 - DNA, 581 bp, Homo sapiens
  misc_feature: GZ8MTXP02IVBZG.52.78.H01.1.454.CMB.2.raw
  modified_base (360)..(360): a, c, t, g, unknown or other
  misc_feature (360)..(360): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtacagcagaggcaggccacggtcccccttatggtgatatataaggaccatggagacggccctgaggactcctgagcgtatctctcggctcctcctcgacgggtacaacncgtctacgttacgatcatcaggtggacggtccggcgaggaagggacgaggcgtagacgttattacgtagtacaaagtacaaacgagaacgtaggtaagtaggttacttaagtggtagtcgtaggttcggacgggtaacggacgaaacgtcgtacggaccgtcccgtacggcgtaacgaacccgaacggtccaccggtcccccgtcggtaccacgtttcccg

SEQ ID NO: 302639 - DNA, 859 bp, Homo sapiens
  misc_feature: GZ8MTXP02IOFCX.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagtcttgggttttccttgttgcttatttagaaggtgtcagtgtgaggcgcagctgggtggaggtcgtgggggacccccgtgttcggtccgaggtccggtcggggggtccctggaccactcctccgtggtgtacgtccctgtggtactttacctaacctttaaacgagtttagttggaattggtaccgtttcggggtccccgccgtaagggcctacccgggaaagggggaacggggtcgttaggggtaggttgggggtcgggaccccgtaagggtaccgggttaggaaaacggccgtaaaggttgggtaaggttagggggaagggttagggaaaaggggtaaacgtaaccgttaaggtcgggggaccggtaaccgttcgggttacgggtaacgggggtaacgggggacccgttaattacccgtaacttcccgttaaaccgttacccggaaagtaaacgtaaacccaaaaccctaaagttaacccgaaaaagtaaaccttactaaagttaccgttaaactaccgtaaccgtaaaagtggaaaccgactaacgtaccctaggaaaccctggtaacccggaagggaacccgtaaccggggttaccgttattaaacgttaccgggtggttacgggtaacggttcgtttaaacggttttggtttaggggtaacgttttcggggttacgtttaccggtttcgaaccctacccggg

SEQ ID NO: 302640 - DNA, 703 bp, Homo sapiens
  misc_feature: GZ8MTXP02GDE28.52.78.H01.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggaggtcgtgggggaggtcgttggtccaggccggtggggggtccctgacactctcctgtgtacgcctcgtggtattctacctttaanagttatggatgacgtggccncgagctcgaggggaggcgtggaggtgggtgccgaggcggtagaagnagtgaggtggaggtaggaaggaagtacgtaagtcggacggtactcgtaggtacggaaacgggcctaacgttacccaaccctacttaccgaaagacgaaccaaacagtaaacaaaacgtaactacaagttacgtaacttacgtaaaccaaaagtcgaacgacgtaaccgcccgttaagaacccgtaacggaccccgggaaacgggtaccgtaacccggggtacccggttttagttaaaaccgtttaccggtggttacggtacgggttaaacggtggtttttacggtttaaggggaagttttcgggtttacgtttccggtacgtaaaccccgtacgtaccgg

SEQ ID NO: 302641 - DNA, 683 bp, Homo sapiens
  misc_feature: GZ8MTXP02IK2LK.52.78.H01.1.454.CMB.2.raw
  modified_base (318)..(318): a, c, t, g, unknown or other
  misc_feature (318)..(318): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcggtgggggaggtcttggtccaggccggtcgggggtccctgacactctccgtgtgtacgcctgtggacttcaccttaacagtttatggatgtacgttggtccnccgaggcctcggaggggaggctaggaggtgggtcgccgaggtcgtaggaagcgtaagtggaagtaggggaaggtggaaacggaagtaccttagtcggcggtaacttcgtagggtaacggacggggccttaacgttacccacctaccgttacgaaagaacgaaaccaaacgtataacgaaacgtaaccttacaagttacgtaacttacctaaccgtaaaagtcgaacgtaccgaagtccctagaacgtactaaccgggagtaccggaccggttaccgttagttaacgtcgtaggtaacggcggttaaacgttaggttttcgtttcggggtatttcggtttacgtacggttcaccgtaacccgtcgg

SEQ ID NO: 302642 - DNA, 604 bp, Homo sapiens
  misc_feature: GZ8MTXP02GE8HL.52.78.H01.1.454.CMB.2.raw
  modified_base (308)..(308): a, c, t, g, unknown or other
  misc_feature (308)..(308): n is a, c, g, or t
  modified_base (582)..(582): a, c, t, g, unknown or other
  misc_feature (582)..(582): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaacagttatggatgacgttgggtccnccgaggcctccgaggggagggctggagtgggtgccagcgtgaagcatgagtgggagtgaggaagactagtgcgggtactcgtagtaggaacgggtccgatttcccgaaccctaccgttcccgaaggtaacgaaaccaaacacttaacaaaacgtaacctacaaagttacgtaacctctaaccctaaagtcgacgccaacgcccttaggacctacgtcccggaaggaccgaccggcgtaggttattacgtgacgcgtaagtgtttgtaaggggtnttggttcgtcgtacacacgtcg

SEQ ID NO: 302643 - DNA, 614 bp, Homo sapiens
  misc_feature: GZ8MTXP02F6BVQ.52.78.H01.1.454.CMB.2.raw
  modified_base (315)..(315): a, c, t, g, unknown or other
  misc_feature (315)..(315): n is a, c, g, or t
  modified_base (361)..(361): a, c, t, g, unknown or other
  misc_feature (361)..(361): n is a, c, g, or t
  modified_base (556)..(556): a, c, t, g, unknown or other
  misc_feature (556)..(556): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctggacactctcctgtgtacgcctcgtggattcaacctttaacagtttatggatgtacgttgggtcccncaggcctccgaggggagggctggagtggggtgccgagcgtagaagnatgagtggaggtgaaggaagactagtcggcgactcgtaggtaggaacgggcctacttccaccgtaccttcgaagacgaaacaaacactaacgaaacgtaacctagaattacgtaactcctaacaaaatcgaagacacgcctagactacgtacccgggaagtacccgacgggtaccttaggtactttacggtaggngaccggtaagttcggtttaggttaaggtatttcggttagtccgttagaccacgtccgg

SEQ ID NO: 302644 - DNA, 626 bp, Homo sapiens
  misc_feature: GZ8MTXP02JE5X8.52.78.H01.1.454.CMB.2.raw
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (546)..(546): a, c, t, g, unknown or other
  misc_feature (546)..(546): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacactctcctgtgtagcctctggattcacctttaanagttatgatgacgttgggccnccaggctccgagggaggctggagtggggcgccgagcgtgaagnagtgagtgggaggtagaacggaagactagtcggacggtactcgtaggtagggaaacggggcctattacccgaacctaccttaccgaaagaacgaaaccaaactactaacgaaaagtaacctactaaagttagtaaactacctaaaccaaaagtcggaacgaccaaggccctaggaacctacgacccggaaggaaccnccggggtacttagttactacgtggagtacgtaggttcgtttcgttaaggggattcggtttgtccgttacgcccaacgtcg

SEQ ID NO: 302645 - DNA, 619 bp, Homo sapiens
  misc_feature: GZ8MTXP02JLDAE.52.78.H01.1.454.CMB.2.raw
  modified_base (418)..(418): a, c, t, g, unknown or other
  misc_feature (418)..(418): n is a, c, g, or t
  modified_base (574)..(574): a, c, t, g, unknown or other
  misc_feature (574)..(574): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagctggtggaggtcgtgggggaggtcttggtccaggccggtggggggtccctgacactctcctgtgtagcctctggattctaaccttaacagttatggtatgtacgttcgggtccgccgaggtcctccggaagggggaacggggcgtaggggaggttggggtcggacccgaggcggtagaaagctaagtggagtggggaggtgaaggaagacttagnggcggtactcgtgtacggaagggtcctattccaccctaccttccgaagacgtaacaaactagtaacaaaagtaactacaattagtaactctaacctaaaagtgagacagaccctaggaaccagtaccggaagaccgacgggtactagttattacgngtcgcgtaagtgtttacgtgggattcggttgtcgttcgccactcg

SEQ ID NO: 302646 - DNA, 531 bp, Homo sapiens
  misc_feature: GZ8MTXP02IH2M5.52.78.H01.1.454.CMB.2.raw
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (491)..(491): a, c, t, g, unknown or other
  misc_feature (491)..(491): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagccagccaggcccctatggtgatatataaggaccatgagaggccctnagggatccctgagcgatctctggctcctctcagggacaacngtcaacgttgatcatcagtgagtccggnagaggacgaggctgaactattactgtacaaatacaacagacagtagtggtaacttatgtgaccgaggttcggacgggtacgggaaaccgagacgtcgaaccgtccgtacggtacngaacccgaaggcctacgacccccgtcggtacctactcccg

SEQ ID NO: 302647 - DNA, 709 bp, Homo sapiens
  misc_feature: GZ8MTXP02HLIE8.52.78.H01.1.454.CMB.2.raw
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (473)..(473): a, c, t, g, unknown or other
  misc_feature (473)..(473): n is a, c, g, or t
  modified_base (671)..(671): a, c, t, g, unknown or other
  misc_feature (671)..(671): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggagcttggtccagccgtgggggtccctgacactctcctgtgtagcctctggattcacctttaacagttattggatgacgttcgggtcccnccgaggcctccggaaggggaaggggctggggaggtggggtcggcccaggcgtagaagcagtgagtgggaggtgaaggaanactagtggaccgtactcgtaggtacgggaacgggccgtattacccgaaccctaccgttaccaaggaacgaaaccaaaacgtanaaccaaaagtaaacctactaaaagttacgtaacttaccctaaaccgtaaaagttcggaaacggtccaacggaccccgttaagacccgttaaccggtacccgggaaacggtaacccggaccggggttacccgtttaggtttaaactttcccggttaggtacggtacgggtaaacgtttggttttcgggtttaaggggtntttgggttttcggtcggttccgacccgtaaccggtccg

SEQ ID NO: 302648 - DNA, 584 bp, Homo sapiens
  misc_feature: GZ8MTXP02FUQVG.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtcccctgacactctcctgtgtagcctctggattcacctttaacagttatggatgacgttgggtccgccaggctccgagggaggggctggagtgggtggccagcgtgaaagcatgagtgggaggtagagggaagactagtgcgactcgtggtagaaggggccgaattccgacctacttaccaagacgaacaaacatacaaagaaactacaatgtaactacaaccaaatgagacacgcctaggaccacgtaccggaggaaccgacggtaccgtgttaaagttacgtggtcgacgtaacgtagtttcgttgggtattcggtttcgtgttcggactacgtaacg

SEQ ID NO: 302649 - DNA, 642 bp, Homo sapiens
  misc_feature: GZ8MTXP02HXRNV.52.78.H01.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagcttggtccagccgtgggggtccctgacnctctctgtgtagcctntggattcaccttaacagttatggatgacttgggtccgccaggctccgagggaaggggctgggagtggggtcggccaggcgtgaagcatgagtgggaggtagaagggaagactagtggacggtactcgtgtaggaacggggccgtattcccgaaaccctaccgttcccaaaggaacgaacccaaaactaacgttaccaaaacgtaacctaactaaattcggtaaactttcctaacccaaaagttggaacgaccaacggcccttagggaacctaacgttacccggaaggaacccgaacggtccggttaaggtaactttacgtggcgtacggtagtagttttacgttggggtattggtttcgcgtttcggctaaccgacg

SEQ ID NO: 302650 - DNA, 725 bp, Homo sapiens
  misc_feature: GZ8MTXP02FSRGG.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactcgaccaaagcaatattaggttattcggtaccagcaggacggccgacggccgaccggtccccctttagttggtagtataagtaacgtaaaggacctaagtaggacggaccggacccctacggacggggtacctcccgtggaacggcgtattccgtcgtccgtacccttccctcgtacggaacgggaacaacgtcggtactacggttacaacttctaacgtcgtagggtacggggtacgggtcccggggacgaaggggacgggaaccggagggacttaggtaaccttaattaccgtacggtaaactaaacctaagaaaccgagtaacgttaagggttaaggttacggttactttaagtggttacggtacggtaacggggtcggggtaaacgggacgggtaaccgaaaggtcccgtacgggtacccggtacgttaacggaccgaccgaaccgtaaccggtcctacccggtcccccgttaggtcccaccggtttccccg

SEQ ID NO: 302651 - DNA, 642 bp, Homo sapiens
  misc_feature: GZ8MTXP02IPT7D.52.78.H01.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagctgggtttccttgttgctatttagaaggtgtccagtgtgaggcgcagctgggtggagtcgtgggggaggcgttggtccagccgtggggggtccctgacactctcctgtgtagcctntgattcactttacagttatggatgacttggtccgccnggctccgagggaggggctggaggtgggtggccgaggcgtagaagcatgagtgggaggtgaaggaagactagtcggcggtactcgtgtagggaacgggccgtattaccgaccacttacccaagacgaacaaaacgctaacaacgaaactactaaagttagttaacttaccaaaccctaaagttacggacgaccgacgtccgtacggaactaacggtacccggaaaggacccgaccggggtaccgttagttaacttacggttcggtacgtaccggtaggttacgttttcggtttaaggggtatttggggtttcgttacgttcgggtacctacggtacgg

SEQ ID NO: 302652 - DNA, 556 bp, Homo sapiens
  misc_feature: GZ8MTXP02IBS8T.52.78.H01.1.454.CMB.2.raw
  modified_base (289)..(289): a, c, t, g, unknown or other
  misc_feature (289)..(289): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggcaggccacggcccccttatggngatatataaggaccatgagaggcccctcgaggggtactccccgtgagcgattccctctggctcctcctcgagggaccaactagtctaccgttgatcatacgagtggacgtccgggcaaggagggacgaggcgtagactattacgtgtcaagtcaacagacagtagtggtacttagtgtgcgtaggttcggacgggagggaccaaaggccgtacggacccgttcggtacggtcgacgtaccgacggtccgccgtcccccgtcggtccc

SEQ ID NO: 302653 - DNA, 501 bp, Homo sapiens
  misc_feature: GZ8MTXP02GQKON.52.78.H01.1.454.CMB.2.raw
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagagcaggcaggcccctatggnatatataagaccatgagagcctnagggactccctgagcgtattcctcgtgctcctcctcagggacaacagtcacgttgatcatcagtgagtcggcagaggcgagctgactatactgtacaatacaacagactagtagtgtacttangtgngtaggttcggacggagggacaaagctacgaccgtcgtagcgacgaccaaggcctcgcccctacggtcc

SEQ ID NO: 302654 - DNA, 723 bp, Homo sapiens
  misc_feature: GZ8MTXP02IS5YJ.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatagtggttattggtacagcagaggccaggccacggcccccttagttggtgatataataaggaccatagagacggcccctacgacgggactcccgtagacgcggtattcccgtcgtcggtcctccctccgttaccgaacgggaccaaacgacgttaccgaacgtttcgacttactactaccgtagtacgggtacggtcccggggacaaggggacggaccgggaggtacgttagggaacttagtttacgtacggttacaaacgttacgaaaccgtacggaaaccgtaaggttaacggttacgggtttactttaagttaggtttacggacggtttacggggtttaccggggacgggggttaaacggacccggtaaacggtaccggttaccgggtaccccgttaccggttaacgggttaaccgaaccggtacccggtaccgggtacccgtaccccggtccccccggtttacggtttacccccgg

SEQ ID NO: 302655 - DNA, 319 bp, Homo sapiens
  misc_feature: GZ8MTXP02FRYDI.52.78.H01.1.454.CMB.2.raw
  modified_base (318)..(319): a, c, t, g, unknown or other
  misc_feature (318)..(319): n is a, c, g, or t
tcagcgcagtacgacacgaccggtgctcgatttagtgtgagtagtttgggtttgggctcaactctcttgtccacccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacgatcgctgagcggctggcaggcgcatagnn

SEQ ID NO: 302656 - DNA, 664 bp, Homo sapiens
  misc_feature: GZ8MTXP02HFWLE.52.78.H01.1.454.CMB.2.raw
  modified_base (245)..(245): a, c, t, g, unknown or other
  misc_feature (245)..(245): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggactcacctgctcgtgganatgcactgaccaaagcaatagtggttattggtaccagcgagacggccgacggccacggccccctttagtcggtgaatatagtaacgaccagtgagacgccacgacgggactcccgtagagcgtattcncgttcggccttcctaccgtcggacgggtaaaccaaacgtagttacccgtacgttacgtacttaccgaacgttaccggtaaggtacggggttaccgggtacccggggaggaaacggggacggggtaaacgggacgggtacgttacgggtaacttacgtttaacgtacgtaactaaacgtacaaacgaccgtagtaagttacggtacgttaaagttacgtaggtacgccggtacggttcggacgggtaacgggaacctaggtccgtacgtacccggtacgtacgggtaacccg

SEQ ID NO: 302657 - DNA, 680 bp, Homo sapiens
  misc_feature: GZ8MTXP02HGVTN.52.78.H01.1.454.CMB.2.raw
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtacagcagngcagcagcccctatggngatatataaggaccagtgagaggccctcgagggactcccgtgagcgtagttctcgtcggcctcctccgtcgaagggaccaacngtccacgtttagacttaccagtacgacggtagggtaccggtacccgggggacaaggggaacgggaacgggaagggtccgtaggaacctttaaggttaacccttggttaaccaaatttaccaaacgtagaacctagggttaagttagggttaaccttaaggtttcgagtacgtaacggtttcggggacggtaacggggaacccgttaaaggcccggtacggtaacccgttaccgtaaacgggttcccgaaccggtccccggaaaaccgggttccgttccccggaccccccggttccgggtaaccgtaccctttccccggg

SEQ ID NO: 302658 - DNA, 735 bp, Homo sapiens
  misc_feature: GZ8MTXP02JY4CE.52.78.H01.1.454.CMB.2.raw
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccacggccccttatggtgatatagtaaacggaccatggaagacggcccctagacggggtactcccgtagacgcgtacttccctcgtggtccttacccctctacgaggggtaccaaacgacgttaccgtacgtttcgaaactctaacgtaccgtaaagggttcgggggaaacggttcccccgggggaacaagggggtaacgggggaaaccggacgggggtaccttaacgggtaacctttaaacgtttaacccgttaggttaaaccaaacggtaaccaaaaaccgtagggtaaaccgtaaggttaaggttacggtttaacttaagttgggtacgtacggtacggggtttaccggggacggggtacgggaaaccgaaacgtcgtaccggtaccccggttaccgttacgggtaacccgacggaccccgaaacgggtccccgtacccggtacccccggtcggttaccccg

SEQ ID NO: 302659 - DNA, 662 bp, Homo sapiens
  misc_feature: GZ8MTXP02F3QJD.52.78.H01.1.454.CMB.2.raw
  modified_base (241)..(241): a, c, t, g, unknown or other
  misc_feature (241)..(241): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctggtgtcagtgtcctcaggacagacggccaggatcacctgctctgganatgcactgccaaagcaatatggttatggtaccagcagaggcaggccacggcccccttatcggtgatataataaggaccatgagacggccctcgagggctcctgagcgtattctcgtcggctccctcctcgacgggaaccaacgagtcctaacgttgaactccgatccgtaggtcggacgggttacccgggacgaaagggaacgggaacgggacgggtacccgttagggtaaccgttaaagtttaaccctagggtttaacaaaacgttaaccaaaaccgaacgtaaacgtaagggttaaggttaaaccgggttaatttacggtaaggttcggtaccgttaaagggtttccggggaacggggaacggggaaacccgaaaggtccggtttaacggacccggttaccggttaacggtaaccccgg

SEQ ID NO: 302660 - DNA, 576 bp, Homo sapiens
  misc_feature: GZ8MTXP02IS5RL.52.78.H01.1.454.CMB.2.raw
  modified_base (417)..(417): a, c, t, g, unknown or other
  misc_feature (417)..(417): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggaccatgagaggccctcgagggatccctgagcgattcctctgctcctctcagggcaacagtcacgttgatcatcagtggagtcgggcagaggacgaggctgactagttactgtacaatnaacagacaagtagtaggtacttaagtgtagtctaggtttacgggcgggaacggggtaaccaaacggtccgtacgtacccggttaccgttaacggggttaacgaaccggaccccgtaaaacgggtccgttacccggtccccccgttacgggtttaccccg

SEQ ID NO: 302661 - DNA, 620 bp, Homo sapiens
  misc_feature: GZ8MTXP02ITPHV.52.78.H01.1.454.CMB.2.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatcggtacagcagagcaggccacgcccctatggnatatataaggacagtgagcgccagaggactccgtgagngacttctctgtcctctcctacgacggcacagtctacgttgatcatcgngtaggacgtcgggcaagggacggacggaggcgtagtaacttacgttacgtacgttaacaaacgttaccaaaagtacgaaacgtaaggttaggtaagttaacttaagttggtagacgttaacgggttacgggggacgggtaaacggggtaaccgtaaacggtccgtaccggtacccggttaacccgttagggtaaccgaaccgaaccccggtaaaacggtccccgtaccggtcccccgtacggttaccccg

SEQ ID NO: 302662 - DNA, 613 bp, Homo sapiens
  misc_feature: GZ8MTXP02I4D0T.52.78.H01.1.454.CMB.2.raw
tcagcgcagtacgacacgaccggtgctcgatttagtgtgagtagtttgggtttgggggctgtggggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtaccagcagagcagcagcccctatgtgatatataagaccatgagaggcctcgagggatcccctgagcgattcctctcggctcctctcgacggaccaacagtccacgttgatcacttcaggttggagtccggggacaggaagggacggaacggccgtaggaaccttacttacgtaggttacaaagttacaaccaaggacctaaggtaggtaggttaacttagtagtagaccgtaggtttccgggacgggaagggacccgtaaaggccgttacgggtaaacccgttccggtaaaggtcccgaaacgggaccccgtaaaacggacccgttcccggtaaccccccggtttcgggtaacccccg

SEQ ID NO: 302663 - DNA, 694 bp, Homo sapiens
  misc_feature: GZ8MTXP02FYSCH.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatagttggttattggtaccagacagaggccaggccacggtacccccttagttggtagataataagtaaacggaccagtgaaggacggccctacgaggactcccgtagacgcgtacttccgtctcggccttcctccgtacgaacgggaccaaacgtacgtacgtaccgttagtaactcaatacgaggttaggacgggtaccggggacgaaggggaacgggacgggacggtacgttacggtaacttaagtttacgtacgtaaacctaaacgtaacaaaacgaacgaaaccgtaaggttaaggttacggttaactttaaggtcggtacggtacgtaagggttaccggggacggggtaaaccgggaaccgtaaacggtccgtaccggtacccggtaccgttacggaacccgaacgacccggtaacggtcccgtcccggtcccccgtcggtaccccg

SEQ ID NO: 302664 - DNA, 543 bp, Homo sapiens
  misc_feature: GZ8MTXP02GJV2U.52.78.H01.1.454.CMB.2.raw
  modified_base (356)..(356): a, c, t, g, unknown or other
  misc_feature (356)..(356): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttatggtgatatataaggacatgagaggcctcgagggatcccgtgagcgattctctcggctcctcctcacgggacaacngtcacgttgatcatcagtggagtcgggcaggaggagaggctgtactagttactgtactaaagtacaaacagactagtagtggtacttatgtagagtacgttcgggacggtagggaccaaaggcgtacggaccgttaccgtacggtcgaacgcccgaacggccgtcggccccctgtccgactttcccg

SEQ ID NO: 302665 - DNA, 714 bp, Homo sapiens
  misc_feature: GZ8MTXP02HLIXI.52.78.H01.1.454.CMB.2.raw
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccagccgtggggggtccctgacactctcctgtgtagcctntggattcacttaacagttatggatgacgttgggtccnccgaggcctccgaggggagggctggagtgggtggcccaggcgtgaagtcatgagtgggaggtgaagggaagacgtagtcggaccggtactcgtggtacgggaacggggcccgtaactttacccgaaccctaccgtttacccgaaggaacgaaaccgaaaacctataaaccgaaaagtaaaccctacaaaagtttacggttaacttacccttaaccctaaaaagttggaaacgtacccgaagaccccgttaggaaacctaacgtacccccgggaaggggaacccaacccgggggtcgttacgttaagtttaacgttcgggttagaccggttaaggtttaccggttttcggtttaaggggtaacgtttggggttttacgttccggttacgtcccgttaaccgtacccgg

SEQ ID NO: 302666 - DNA, 604 bp, Homo sapiens
  misc_feature: GZ8MTXP02GCA4X.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattggtaccagcagaggccaggccacggccccccttagttcggtgatataagtaaggaccagtagagacggccctcgagggactcccgtgacgacgtacttccgtctggtcctccctccgtccgaggggaccaacgacgtaccgtacgttagaactacaactccgtaagtgggtacggtccggggacaagggtaagggacggaggcgtagacgttattacgtgtacaatacaacagacagtagtacgtattagtgtgtacgtacggttcggacgggaaggaccgaaaggtcgtacggtacccgtcgtaacggtaaccgacgacccgaacggccgtccgccccgtcggttaccccg

SEQ ID NO: 302667 - DNA, 567 bp, Homo sapiens
  misc_feature: GZ8MTXP02GAZOC.52.78.H01.1.454.CMB.2.raw
  modified_base (360)..(360): a, c, t, g, unknown or other
  misc_feature (360)..(360): n is a, c, g, or t
  modified_base (456)..(456): a, c, t, g, unknown or other
  misc_feature (456)..(456): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttattcggtgatatataagaccatgagacgcctcgaggactcccgtgacgcgatctctcggctccctctcacggacaacngtcacgttgatcatcagtgacggtccggcgagaggacgaggctagactattacgtgtactaatacaacagacagtagtacggtacttagtgtacgntaaggttcgggacgggaacgggaccgaaaggtccgtaggacccgttacgttaacggcccgacgcccggaaaggcccgttccggcccccgtacggtccctaccgtttccccg

SEQ ID NO: 302668 - DNA, 576 bp, Homo sapiens
  misc_feature: GZ8MTXP02F1SEH.52.78.H01.1.454.CMB.2.raw
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
  modified_base (568)..(568): a, c, t, g, unknown or other
  misc_feature (568)..(568): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcttggtccagccgtgggggtccctgacactctcctgtgtagcctctggnttcacctttaacagttatggatgacgttgggtccnccaggctcgagggagggctggaggtgggtcgccaggcgtagaagcatgagtgggaggtgaaggaanactagtggcggactcgtgtagggaagggtccgtaattcccaacctacttcccaaaggacaactaaacataccaaagtactacaaattgtaactacgtaccaaaagtcgaagtcaacgtccagacctagccgaaggaccacggccgttataacttcgtgagcgtagttagtttcgtgggtacttggttcgtggttcnctaacgcg

SEQ ID NO: 302669 - DNA, 770 bp, Homo sapiens
  misc_feature: GZ8MTXP02H3MW5.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttagttcggtgatataataaggaccagtgagacggccctacgagggtactcccgtgacgcgtattcccgtctcggtcctccgtcctacgaacgggaccaaacgtacgttaccgtacgtttcgactccaacttccgtaagggtagggtacgggtacccgggggacgaaggggaacgggaaccgggagggtaccgtaacggttacttaaagtttaaccttggttaacctaaactttaaccgaaaacccgaaggtaaaccttaaacgggtttaaggttaacggtttaaaccgtttagttaggttacggtaaccgttaacgggggtttaccggggaaccgggggtaaggggtaaaccccgaaaggggtacccgttaccggggtaaccccgtttacccggttaacggggttaacccgaaacccggggacccccgtaaaacggggtccccgtttacccccggggttccccccgtttaaccggggtttaccccc

SEQ ID NO: 302670 - DNA, 637 bp, Homo sapiens
  misc_feature: GZ8MTXP02ICLRF.52.78.H01.1.454.CMB.2.raw
  modified_base (290)..(290): a, c, t, g, unknown or other
  misc_feature (290)..(290): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacaggacggccaggatcacctgctctggagatgcactgaccaaagcaatatggttattggtacagcagagccaggccacggccccttatggtnatatataaggacatgagaggccctcgaggggactccccgtagagcgtattcctcgtggcctcctcctcgaacggggacaactagtcctacgttgactacatcgtaggtcggacggtccggggcgaaggacgggacggaggccgttaggacttacgttactcggtaacaaagttacaaacgaggaactaggttagttacgggttacttaagtgttgacgtacgggtttacgggacggggtacgggaacgtaaacggtcgtaccggtacccggttaccgttacgggtccgaaccggaccccggaaacggggtcccgtaccccggtccccccggtacgggtttacccccg

SEQ ID NO: 302671 - DNA, 594 bp, Homo sapiens
  misc_feature: GZ8MTXP02JMTML.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaatatggttattggtaccagcagagcaggccacggccccttagtggtagatatagtaacgacatgagacggccctagagggactccgtgagcgtattccctcgtcggtcctccctcgtacgacgggaccaacgacgtaccgtacgttgaactcatcgaggttcggacggtccgggagaggaaggacggaggcgtagtactatttacgtgtaataactacaacgagaacgtagtagtagttaacgttatgtacgtacgtacggttcgggacgggtacggaaccgaagtcgtacgtaccgtaccgtaggtaaccgacgacccgtacggaccgtcccgccccgttacggtacccg

SEQ ID NO: 302672 - DNA, 652 bp, Homo sapiens
  misc_feature: GZ8MTXP02HHI22.52.78.H01.1.454.CMB.2.raw
  modified_base (322)..(322): a, c, t, g, unknown or other
  misc_feature (322)..(322): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (462)..(462): a, c, t, g, unknown or other
  misc_feature (462)..(462): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagcgtggtggagtcgtgggggaggtcttggtccaggccgtggggggtccctgacactctcctgtgtacgcctcgtggacttctaaccctttaacagtttagttggatgtacgttgggcccnccgaggctaccggaggggaaggggctgggagtggggtgcccaggcgtgaaagcagtgagtggaggtgaaggaanactagnggcgactcgtggtacggagggccgacttaccgacctacttccgaagaacgaacaaactanaccgaaaataactacaaagttacgtacttacctaaccgaaaatcggaacgaccacggacctacgaacacgtaccggaaggtaccgacccgggtacgttacgttaaagttccgtaggtacggcgttacggttaggtttttacgttggggtaatttcgggtttaggtccgtttacggacccaaccggttccg

SEQ ID NO: 302673 - DNA, 574 bp, Homo sapiens
  misc_feature: GZ8MTXP02FFJSC.52.78.H01.1.454.CMB.2.raw
  modified_base (521)..(521): a, c, t, g, unknown or other
  misc_feature (521)..(521): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagcttggtccagccgtggggggtccctgacactctcctgtgtagcctctggattcaacctttaacagttatggatgacttgggtccgcaggctccgagggaaggggctggagtgggtgccagcgtgaagcatgatggaggtgaggaagactagtgcgggactcgtgtagaacggggccgtaattcccaacccgtaccttcccgaaagacgaacaaacactacaaaagactacaaatgtaactctaccaaaatgaagcacgcctagacacgtccgaaggaccacggccgtagtaactttacgngtcgacgtagtacgtttcgttggggactttcggttgtcgtttagccacgtacg

SEQ ID NO: 302674 - DNA, 578 bp, Homo sapiens
  misc_feature: GZ8MTXP02GT3HB.52.78.H01.1.454.CMB.2.raw
  modified_base (417)..(417): a, c, t, g, unknown or other
  misc_feature (417)..(417): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcaactgaccaaagcaaatagtggttaattggtaccagcaggacggcaggccacggtacccccttagtggagataatataaacggaccatagaggacggccctacgaggacgtccctgaggtccgtattccctcgttcggccttcctccgtacgacgggaccaacgacgtctaccgttgatctaatacgngtacggacgcggacgaggacgacggagcgtgactagttactgtacaatacaanacganagtagtaggtacttatgtagcgtaggtacggaccgggaggaacgaaacgcgtacgaccgtcgtagaacgacggaccctaaggcctaccgcccccggtcgtacc

SEQ ID NO: 302675 - DNA, 654 bp, Homo sapiens
  misc_feature: GZ8MTXP02IIR07.52.78.H01.1.454.CMB.2.raw
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (442)..(442): a, c, t, g, unknown or other
  misc_feature (442)..(442): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctgacactctcctgtgtagcctctggattcaccttaacagttatggatgacgttgggtccnccgaggcctaccgaggggaagggcgtggaggtggggngccgaggcgtagaagcagtgagtgggaggtgaggaagactagcggcgtactcgtgtagggacggccgtatcacctacttccgaagacgaaccaaanataacaaagaactacaaagttacgttaactacctaaacctaaaagtggtaacgaccacgtacccgtacgaaacctaccggtaacccgggaaggaacccgtaaccggggtcccggttaagtttaacgttaaccgtgggtaacgtccggtaaggtttacggtttcggttaaggggttattcggtttcgggtacgtttcgaccgttaaccgacgg

SEQ ID NO: 302676 - DNA, 506 bp, Homo sapiens
  misc_feature: GZ8MTXP02FZ155.52.78.H01.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (343)..(343): a, c, t, g, unknown or other
  misc_feature (343)..(343): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtacagcagagcagccaggcccctatgngatanataaggcatgagaggcctcgaggatccctgagcgtatctctggctcctctcaggacaacngtcacgttgatcatcagtgagtccgggcaggaggacgaggctgaacgttattacngtacaaatcaacagacagtagtgtacttangtgntaagttcgggnggaacgggaccaggctagaccgtctacggtcagcccgaaggcacgccccgtggtccacttccg

SEQ ID NO: 302677 - DNA, 658 bp, Homo sapiens
  misc_feature: GZ8MTXP02FTOP2.52.78.H01.1.454.CMB.2.raw
  modified_base (244)..(244): a, c, t, g, unknown or other
  misc_feature (244)..(244): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctctggggcctcctatgaactgacacagcccaccctcggtgtcagtcgtcctcaggacagacagccaggatcacctgctcgtgganatgcactgaccaaagcaatagtggttattggaccagcagacggccaggccacggtcccctttagtcggtagtatataagtaaggaccagtggaaggacgtcccccgtagacggactcccgtagacgcgtacttccgtcgtcggcccttcccgtacctacggaacgggtaaccaacgtacgtacgtaaccgttgaacttacacgtcgtacgggtcgggtaccggtcgggaccgaaggggaacgggacggtacggacgttacggtaactttaacgttacgttacgtactaaactacgaaacgaggtaactaacggttaagttacgggttaacttaaggttgtacggtaccgtaagggttccggggaacgggaacgggaccgtaaacggtccgtaaccggtaccgtacggtaacggg

SEQ ID NO: 302678 - DNA, 703 bp, Homo sapiens
  misc_feature: GZ8MTXP02I2JFQ.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgtgctattttagaaggtgtccagtgtgaggcgcagctgggtggagtcgtggggggagtcgttggtccacggccggttggggggtcccctgaccactcctcctggtagtacgccctcgtaggtacttcctaacctttaactagttattggatggtaccgttgggtcccgccgaggcctaccggaaggggaaggggtctagggagggtgggtcgccgaggcgtacggagcagtgagtggaggtgaaggacactagtggcgtaactcgtaggtaggaacggggtcacgttaccacccgtaccttaccgaagaacgaaacccgaaaatactaacgaaaacggtaacctacaaagttagttaacctacgtaaacctaaagacgtacgacaacgtcctaaggacctaacggtaccggaagacccggtaaccggtacgtaccggtttattaaacggtggtaccggtacgttaacggttaacggttttcggttaagggttacgttggttttaccggtcggtttaccggaaccttaaccgtaccgg

SEQ ID NO: 302679 - DNA, 741 bp, Homo sapiens
  misc_feature: GZ8MTXP02F1JY8.52.78.H01.1.454.CMB.2.raw
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgcttattttagaaggtgtccagtgtgaggcgcagctgggtggagtcgtgggggaggtcttggtccaggccgtggggggtccctgaccactcctcctgtgtacgcctcgtggtacttcaccttttaaacngtttatggatgtacgttcgggtcccnccaggcctcggaggggaacggggcgtgggaggtgggtcggcccaggcgtagaagcagtgagtggggagtggaaggtaagacgttagtcgggcggtaccttggtagggtacggaaacgggggtcctacttacccaacccgtaccttaccgaacggaaacgaaacccaaacaacttaacgaaaacggtaacccttaaacgtaaacgtttacgttaaacctaacccgtaaacgaaaacgtcggaacgaccgaccgtaccgtaacgaaccgtaaccggacccggaaaccggaccggtacccgggtaccggttaacgttacgtttaacggtcgggttacggtacgggttacggtttacggttttacggtttaaggggttacggtttcggtttcggttaccgttaccgacccgtaccggtaccg

SEQ ID NO: 302680 - DNA, 592 bp, Homo sapiens
  misc_feature: GZ8MTXP02I7J6F.52.78.H01.1.454.CMB.2.raw
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggagcttggtccagccgtgggggtccctgacactctcctgtgtagcctntggattcacctttaacagttatggatgacgttgggccncaggctccgagggaggggctggaggtggggtgccaggcgtagaagcatgagtgggagtggaaggaagactagtggaccgtactcgtggtaggaacgggcgtacttacccacctactccgaagacgaacaacgactacaaaacgaactacaaattgtacttacctaaccaaagttcgacgaccacgcctagactacgtccggagaccgacggccgttagttacttacgtcggtagacgtacgtgtttcgttaagggtattggtttcggtcgttcgacctaccgtcgg

SEQ ID NO: 302681 - DNA, 662 bp, Homo sapiens
  misc_feature: GZ8MTXP02FIYCA.52.78.H01.1.454.CMB.2.raw
  modified_base (381)..(381): a, c, t, g, unknown or other
  misc_feature (381)..(381): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagcaggccacggtccccttatggtgatatataacggaccagtgagacggccctacgaggactcccgtgagcgtattccctcgtcgctcctcctcgacgggaccaacacgtctacgttnactcatcgaggtaggacgtccgggacgagggacggacggacggacgtgaacgttaacgttactacggtactaacttaccaaaacgtacggaacgtaacgttaagggttaggtttaaaccgttagttaggttacgtacggttaacgggttaccgggggtacggggaacggggtaaacccgtaaacggtcccgtacgggtaccccgttccggttaaccgggtaacccgaacgacccccggaaacggtccccgttaccggtccccccgttcgggttaacccccg

SEQ ID NO: 302682 - DNA, 613 bp, Homo sapiens
  misc_feature: GZ8MTXP02GJ5BT.52.78.H01.1.454.CMB.2.raw
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccagccgtggggggtccctgacactctcctgtgtacgcctctggattcacctttaacagttatggatgacttgggtccncnggctcgagggagggctggagtgggtgccaggcgtgaagcatgagtggagtgaggaanactagtgcgactcgtgtagaaggggcctattccgaacctaccttcgaagacgaaacaaacacgtacaaagtaaacctacaaagttgtaacttacctaaccaaaagttcggaacggacacgtacctagaaccaaacgtcccggaaaggacccgaacgggtccgttaggttacttaacgtggtacgacgtaaggttacgttttcggttaaggtattggtttcgtaccgttcggacctaacccgtcgg

SEQ ID NO: 302683 - DNA, 547 bp, Homo sapiens
  misc_feature: GZ8MTXP02IPXPP.52.78.H01.1.454.CMB.2.raw
  modified_base (278)..(278): a, c, t, g, unknown or other
  misc_feature (278)..(278): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctagggcctcctatgaactgacacagcccaccctcggtgtcagtgtcctcaggacagacggccaggatcacctgctctggagatgcactgaccaaagcaatatggttattggtacagcagagcagcagcccctatgngatatataaggccatgagaaaacggcctacgacgggactccgtgacgcgtattctctcggcctcctcctcgacggacaacngtctacgttgatcatcgagtggagtccggnaggagacgagctagactatacgtgtacaatacaacgagactagtaagtgttacttagtgtgacgtaggtacggacggaacggacaaacggcgttacggaccgttccgtaacggtacacgccgaaacggtcgtaccgccccgttcgtccgacgttcccg

SEQ ID NO: 302684 - DNA, 566 bp, Homo sapiens
  misc_feature: GZ8MTXP02GX7RM.52.78.H01.1.454.CMB.2.raw
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagaggccaggccaggcccccttagttcggtgatatataaggaccatgagacgcctcgagggactcccgtgagcgtattctcgtcggtcctcctcctacgacggtaccaacgngtacacgttagactcatcgaggtgggacgtccggganacggaggacgacggctgaactattactgtacaatacaacagaactagtagtaggtacttagtgtgcgtaggttcggagggtacgggaccaggcgtacggaccgtccgtacggtccgacgcccgtaacggccgtccgtccccgtcggtcccactttcccg

SEQ ID NO: 302685 - DNA, 704 bp, Homo sapiens
  misc_feature: GZ8MTXP02GN880.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccacggcccctatcggtgatatagtaacgaccatgagacggccctcgagggactcccgtagacgcgtattccctcgtcgctccctcctacgagggaccaactagtaccgtacgtttgatacgagtaccgaggttacgggacggttccggggacgaagggaacgggacggacgggtaccgttagggaaccttaacgtttaccgttaggtaacgtaaacgttaccaaacgaacgtaaccgtaacggttaacggttagggttaaacctttaaggtggtaggtaccggtaacggggtttaccggggacggggttaacggggtaaacccggtaaacggccggttaccgggtacccggttaccggtaacgggttaaccgtaacccgggacccgtaaacgggtcccgtacccggtcccccggttaaccgggtttcccccg

SEQ ID NO: 302686 - DNA, 648 bp, Homo sapiens
  misc_feature: GZ8MTXP02H4A8J.52.78.H01.1.454.CMB.2.raw
  modified_base (308)..(308): a, c, t, g, unknown or other
  misc_feature (308)..(308): n is a, c, g, or t
  modified_base (425)..(425): a, c, t, g, unknown or other
  misc_feature (425)..(425): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcacctgctctggagatgcactcgaccaaagcaattatggttattggtaaccagacgaggaggccgacggccgacggtcccccttagttacggtgatataanaaggacctagtgacggaggccctagacggactcccgtgacgcgtattctcgtcggtcctccctcctcgacggacaactggtctacgtcgtaatctacgctaggtcgacggtcggganagggacggagacggctagacttaagttactacggtacaaagtcaaaagacgtaaactagggttacgtaggttagttaagtttggacgttacgtacggtttcggggaacgggtacggaaaccgtagtaccgtacgggtaacccgtacggtacggtaccgaacggtcccgtaaaggtcccgtttacccggcccccgtttaccgggtaacctacccgtttccccgg

SEQ ID NO: 302687 - DNA, 836 bp, Homo sapiens
  misc_feature: GZ8MTXP02F1M9L.52.78.H01.1.454.CMB.2.raw
  modified_base (264)..(264): a, c, t, g, unknown or other
  misc_feature (264)..(264): n is a, c, g, or t
tcagcgcagtacgacacgaccggtgctcgatttagtgtgagtagtttggggtttggggctggggagcctagctgtgctgtgggtccaggaggcagaactctgggtgtctcaccatggcctggactccctctacttctcccctcctcactctctgcacaggctctggggcctcctatgaactgacacagccaccctcggtgtcagtgtcctcaggacagaccggccaggatcaccttgctctggagatgcactcgccaaagcaanatggtatggtaccagcgagaggccaacggccgacggtacccccttaagtggtagtataagtaacttaacgggaacctaagttacgaaggtaccggggacccctaccgtaacggggtaaccttcccccgtaggtaaacggcccgggtaattttcccggtacgtttcggggtccttaacccgttcccttaacgaaccgggggtaaacctaaaaccgggacgtttaaccccaagggttttaccgaaactttaacccgtaaacacccggtaaaggggtttccgggaccgggggttaaaaccccgggggtctaaaacgggggaacgggtttaaccggggtaaacgggttccgttacggggtaaaaccccttaggtttaacccgtttacgggtacccaaaacggtttacccaaaacccgaaaggttaccgtaaagggtttaaagggtttacggggttaaaccctttaaacggttaggttcggaaccccgtaaagggggtttcgggacccggggtaacgggtaacccgaaacggtccggtacccggtttacccggaaacccggtttcgtaaccccgggg

SEQ ID NO: 302688 - DNA, 654 bp, Homo sapiens
  misc_feature: GZ8MTXP02FGJLH.52.78.H01.1.454.CMB.2.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggcccccttatggtgatatataaggaccatgagaggccctcgagggacnccctaggacgcgactttctcgtcgggccttcccgtccttcgaacggggaccaaacngtccacgttgatcatcgagtgggacgtccgggcaaggacggaacgtaggctagaaccttattaacgtgtaccaattacaaacgagaaccgtaggttaaggtggttaacctttaagtggtacggtacgtacggggtttaccgggacggggtaacggggaaacccgaaaggtccgtaacggtaaccccggtttccgtaaaacggggtccaaacgggaacccccgaaacgggtcccgtaccggcccccccggtttacgggtcccctaacccgtttacccg

SEQ ID NO: 302689 - DNA, 790 bp, Homo sapiens
  misc_feature: GZ8MTXP02H7MHC.52.78.H01.1.454.CMB.2.raw
  modified_base (189)..(189): a, c, t, g, unknown or other
  misc_feature (189)..(189): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctnaggacagacggccaggatcacctgctcgtggagatgcactgaccaaagcaaatagtggttattcggtaccagcaggaggccgaggccacgggtcccccttagtcggtagaataatagtaaacggaccagtagaggacggccctacgacggtactcccgtagcgcgtattccgtctccggccttcccgttccacggtacggggacctaaacgtacgttacgtaacgttacgtacttaacgtacgtaccgtaagggttacggggtaccggtacccgggggtagaaacggggtaacgggggaacccggggttagggggtacctaacggggttaaaacccttaacggtttaacccgtagggttaaaccgtaaaccgtttaaaccaaagttaaaacggaaccgtaagggtttaacgggttaggtttaaaaccgtttattacggggtacggtaacgttacgggtttacggggacggggtacgggaaaccccgttaggtaccctacgggtaccccgttaccggttacgggtacccgaaccggtaaccccgtaacggccccgttccggtaaccccccgttccgggtaacccttccccggtttaaccccg

SEQ ID NO: 302690 - DNA, 558 bp, Homo sapiens
  misc_feature: GZ8MTXP02GLTZF.52.78.H01.1.454.CMB.2.raw
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctgagggatccctgagcgattctctcggcctccctctcgacgggaccaacngtccacggttgactcatcgagtcgggagtcccggggcgaggacggaaggaggctggacttattactgtacaatacaanagacagtagtggtacttatgtgcgagttcggacggtagggaccgaaaggcttacggaccgttccgtacgtcgacggaacccgtaacggcctccggcccccgtcggtcctactttccccg

SEQ ID NO: 302691 - DNA, 721 bp, Homo sapiens
  misc_feature: GZ8MTXP02HQGEL.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaacatggagttggggctgagcttgggttttccttgttgcttattttagaaggtgtccagtgtgaggcgcagctgggtggagtcggtgggggagcttggtccgaggccggtgggggtccctgacactctcctgtgtacgcctgtggtacttctacctttaatagttatggatgtacgttcgggtccgccgaggctaccggaggggaacggggcgtagggtaggtggggtcggccgaggtcgtagaagcagtgagtagggaggtacgaaggagtacgtagtcggacgtactcgtaggtagggaacggtccgtaactcccgaacctaccgttccgaaagaccgtaaacaaactactaacgaaaacgtacctaacgtaaagttacgttaaccttaacctaaaccgtaaaagtcggaaaccgcgtaacgtacccgtaaaggaccctaaccgggtacccggggaaacggttacccggaacccccggggttacgtttaggtttaaccttaacggtgggttacggtaaccggtaggttttccggtttacggtttggggtacgtttggtttacgtcgttcgaacccgtacgtcccgg

SEQ ID NO: 302692 - DNA, 618 bp, Homo sapiens
  misc_feature: GZ8MTXP02ICI9M.52.78.H01.1.454.CMB.2.raw
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtgganatgcactcgacaaagcaatagtggttatggtaccagcagaggccaggccaggccccttatcggtagtatatagtaaggacctagnggaacgacggccccgtagggggtaaccttcccgtaggacggtcgtaacttcgtccccgtggtacccttccccttaccgtcgaacggggtaccacgtacgtctaaccggtttgacttcgattcgaagttgggacgtcccggganaggaggacggaggctagacttagttacngttacaatcaaacgagtacgagtaggtgttaactgtagtcgcgtagttccgggcggacggaaccaagtcgttacggaccgttacgttacggaccgaaccggtacgaacggcctccggtcccctcggtacctacccg

SEQ ID NO: 302693 - DNA, 525 bp, Homo sapiens
  misc_feature: GZ8MTXP02H3OYR.52.78.H01.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgccctntggagatgcactgccaaagcaatatggtatggtaccagcagagcagcaggcccctatgngatatataaggaccatagagaggccctcagggactccctgancgattcgctggcctctcctcagggacaacagtcacgttgatcatcagtgagtccgggacaggaggacgaggtctaggactagttactgtactaatcaaacagaaccaggtagagggttacttaatgtagtccaggtttccggacggtaaggggaccaaaggtcctaggacccgttctaacgggtcc

SEQ ID NO: 302694 - DNA, 588 bp, Homo sapiens
  misc_feature: GZ8MTXP02JT7KU.52.78.H01.1.454.CMB.2.raw
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccaggccgtggggggtccctgacactctcctgtgtagcctctggattcacctttaacagttattggatgacttgggtccnccaggcctccgagggaggggctggaggtgggnggcaggcgtgaagcatgagtggaggtgaggaagactatggacggactcgtagtgaaaggggccgtattcccgaaccctaaccttcccaagacgaaccaaacacgtacaaagaaacctcgaaaatgttaactcctaccaaatagacgtacaacgcctaggacatcccggagaccacgggccgttagtattcgagtgacgaggtagtttcgttggggacttgggttcgtcggtttcgaccgacgtacgg

SEQ ID NO: 302695 - DNA, 749 bp, Homo sapiens
  misc_feature: GZ8MTXP02HBP30.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggtcccccttagtggtgatatataacgaccatgagacgcctcgaggtactccctgacgcgtattcccgtctggcctccctccgtacgacgggacctaacgacgtcctaccggttgtactacacgttaccgagggtacggtacggtccgggacgaacgggaggacgggtagtcccgttaggaaaccttagttaacgtacggtactaaaacgttaccgaaaaccgtaaggaaccgttaacggttaaagggtttaaccggggtttaaacttaacggttcgggttaaagttccgggttaaccggggtttacgggggacccgggggtaaacggggaaaccccgttaaacgggcccgtttaaacccgggggaaaccccgttttcccggttaaaacgggtccccggtaaaaccggtacccccggaaaaccggtaccggttaccccccggtcccccccggtttaacgggtttaccccccg

SEQ ID NO: 302696 - DNA, 676 bp, Homo sapiens
  misc_feature: GZ8MTXP02FTCQ9.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgtcttattttagaaggtgtccagtgtgaggcgcagcgtggtggaggtcggtgggggaggtcgtttggtccgaggtccggtcggggggtcccctgacctactccttccgtgtgtacgtcctcgtggtacttcctaacctttaacgagtttagtggtagtcgtacgttcggggtcccgcgacggtcctaccggaaggggaacggggtcgtgggaggtcggggtcggaccgaggtcggtagaacgctagtgagtgggaggtaggaaaggaagtactaggtcgacgtacgtcgtaggtaggaacggcgtactaccaccgtaccttcgaagaacgtaacaaacacttaacgaaacgtactaaccgaattagtaactaccctaaactaagtcgaacgacctacgacgtacgactacggaccgaaagtccgaacgtccgttagtacgtacgttggcgtacgtaagttcggtttaggttggtacggttgttacggtcgttcgacgtaccgtccg

SEQ ID NO: 302697 - DNA, 576 bp, Homo sapiens
  misc_feature: GZ8MTXP02JMLBH.52.78.H01.1.454.CMB.2.raw
  modified_base (348)..(348): a, c, t, g, unknown or other
  misc_feature (348)..(348): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtacagcagagcaggcaggcccctatggtgatatataagaccatgagaggcctcgaggactccctgacgcgatcgtctggcctcctctcagggacaacngtcagttgatcatcagtgagtcgggacagaggacgagctgactatactgtacatacgaactagactaggtagtacggttaacttagtagtgacggtacgttacggggacggtacgggggaacctaaacggccgtacgggtaacccgttccgtaaacgggttccgaacggtaaccccgaaacgggtacccgttcggacccccctaacggggtccctaacccgtttcccg

SEQ ID NO: 302698 - DNA, 631 bp, Homo sapiens
  misc_feature: GZ8MTXP02G0WS4.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtcgtcctcaggacagaccggccaggatcacctgctcgtggagatgcactgaccaaagcaaatagtgttattaggtaccagcaggacggccaggccacggtcccctttagttcggtgatatagtaaggaccagtgagacggtccctacgagggtactcccgtgacgtcgtacttcccgtcgtggtccctacctccgtacgtaacgggaccaacgtacgtccgtaacgttgaactcgaactcgtaggttcggacgggtcccggggagaacgggaggaccggtaaggtcgtacggtaaccttagttaacgttgtaaactaagtaccaacgtagaaacgtaggttagtacggttattatggtagtacgtaaggtcgggacggagggaaccgttaggacttcggaaccgtccgtggtaaccgccgacgacgtccgccgtcccgtcgtacc

SEQ ID NO: 302699 - DNA, 772 bp, Homo sapiens
  misc_feature: GZ8MTXP02G2EX7.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtcgtcctcgaggacagacggccaggatcacctgctcgtggagatgcactgaccaaagcaatagtgttattggtacctagcagaggccacggccgacggacccccctttagttcggtacggtattaagtaagttaaacggaacctaagtaggaacggacggtacccgtacgggtaacggggacttaccccgttaggacggtacggtaacgtttccccgttaccgttacgggtccccttacccgttcccgttaccggaaacgggttaccgaaaccgtaggttacccgtacgtttacggaacttctaacttaccgtaggtaacgggtacggtaccggggacaacgggaacggacggacggcgttaacggactttaacttaacgtacggttacctaaacgttaacaaaaccgtaagaaaccgaaggtttaaaccgggttaacggtttaaacgtttaacggtcgggtttagacgggttacggtttacggggaccggggttaaacgggaaccgtaacggtacgtaccgggtaaccgttaccgtaaggttccgaacgtaccggacgttaccgcccgtccccgtacggtccccg

SEQ ID NO: 302700 - DNA, 731 bp, Homo sapiens
  misc_feature: GZ8MTXP02HNFA0.52.78.H01.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccacctcggtgtcagtgtcctcaggacagacggccaggatcacctgctctggagatgcactgaccaaagcaatatggttatggtacagcagagccagccacggcccctatggnatanatagacatgagaggcctgagggactccgtggacgacgtattctctcggtcctcctccgtacgagggaccaacgtcgtcaaacgtttgaactactaacgtcgtaagggtacggtacggtcccgggaacgaacgggacgggaacggaacgggtccgttaagtaaaccgtttaacgtttaaaccgttacggttaaacccaaagtttaaccaaaaaccgttaggaaaaccgttaagggttaaaggtttacgggttaaaacctttaggtcgttaaagggtccgttaaacggggtttccgggggaaaccggggttaaaacgggggaaccccttaaaagggcccgttacggggtaaaacccccgtttccgggtacggttaaccgaaccggtaaccccggaaaacggtccccgttcccggacccccggttaccggtaccgttacccctttccccgg

SEQ ID NO: 302701 - DNA, 578 bp, Homo sapiens
  misc_feature: GZ8MTXP02IGR3S.52.78.H01.1.454.CMB.2.raw
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggagcttggtccagccgtgggggtccctgacactctctgtgtagcctgtggattctacttaacagttatggatgacgttggtccncgaggctcggagggaggcgtggnggtgggtcgccaggcgtgaagcagtgagtgggaggtagaggaagactagtggcgtactcgtgtagggacggcgtacttccacaccttaccgaggaacaacaaatactaacaaacgaactacaattacgtactactaacaaatgagacacgcgtagactacgtaccggaacggacgtacggtccgttagttaacttcgttaggcgtacgtaggttctttggttggtagttgttgtcgttcggctacgccg

SEQ ID NO: 302702 - DNA, 638 bp, Homo sapiens
  misc_feature: GZ8MTXP02IXLR5.52.78.H01.1.454.CMB.2.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatntggttatgtaccngcagacgcagccaggtcccctagtgcgatanataaggaccagtgagacgcctagaggactccctgacgcgtatctcgtcggtcctacctccgtacgacggaacaacgtgtacaggttacgatcctaancgtacgtgacgtcccggganaaggacggacgaaggtcctagaaccttagttactacgtaactaactacgaaacgacgtaacgaggttaagtacggtttaactaagttggtacggtaccgtagggttacgggaacggttacgggaaacgaaaggttccgaacggttaaacccggtcgttaaccgtacgaaacccggttaacccgtaacgggccgttaacccccggccgttacccgggttacctaacccgtttcccgg

SEQ ID NO: 302703 - DNA, 676 bp, Homo sapiens
  misc_feature: GZ8MTXP02JT4J3.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggagtcgttggtccagccggtcgggggtccctgacactctccgtgtgtagtcctgtggtacttcctaacctttaactagttattggatcgtacgttcgggtccgccgaggccgtccggaagggggtacgggtcgtaggggaggtggggtcggccgaggcgtaggaaagctagtggacgtgggagggtagaaggaaagtactagtcggacggtacttcgtagggaggaacgggtccctagttacccaacccttacgtaccgaagtaacccgaacaaacacgtaacaaacgtaactagtaatacgtatacctacaaatcgacgtaccgacgtcctagaccgtacggtaaccggaggacccgtacccgggtacgtttacgttactaaccggtgtaccggacggtaggttacgttttacggtaaggtcgtttaggtttcggtcgtacgtacctacgtcg

SEQ ID NO: 302704 - DNA, 616 bp, Homo sapiens
  misc_feature: GZ8MTXP02GH07F.52.78.H01.1.454.CMB.2.raw
  modified_base (459)..(459): a, c, t, g, unknown or other
  misc_feature (459)..(459): n is a, c, g, or t
  modified_base (588)..(588): a, c, t, g, unknown or other
  misc_feature (588)..(588): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtacgcctctggattcacctttaacagttattggatgacgttgggtccgccgaggcctccggagggggaacggggcgtggggaggtggggtcggcccgaggcgtgaaagcagtgagtgggaggtggaggaagactagtggacgacttcgtggtaggaacggggccgtattcccacctaccttccgaagacaacaaacntaacaaagtaactacaattcgtaactcctacaaaatgacgacacggctagaccacgtcccggaaggaccgtaccgggtccgttagttattaccgtgggtacgacgtaggttcgtttggttaaggggttntttcggttcgtcgtcgaccgtaccgtcg

SEQ ID NO: 302705 - DNA, 618 bp, Homo sapiens
  misc_feature: GZ8MTXP02FLXQQ.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagccgtggggggtccctgacactctcctgtgtagcctctggattcacctttaacagttatggatgacgttgggtccgcaggctccgaggggaggggctggaggtggggtggccaggcggtagaagcatgagtgggagtgaggaagactatgcggactcgtagtgaaacggggccgattccgaaccctactttacccaaagtacgaaacaaacacttaacaaaagtacacaaattcgtaactacctaccaaaatgaagtccaacgtacctggaaacctacgacccgggaaggtaaccgaacccgggtccgttaggttactttaaccgtgtacggacgtaggtacgttttcgtggggtaactttggttacgtcgtttcgacctacgtacg

SEQ ID NO: 302706 - DNA, 753 bp, Homo sapiens
  misc_feature: GZ8MTXP02JCSJY.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagcgtggtggagtcgtgggggaggtcgttggtccaggccggtcggggggtccctgactactctccgtgtgtacgcctcgtggtacttcctaacctttaactagtttattggattgtacgttcgggtcccgccgaggtccctaccggaaggggtaacggggcgtaggggagggtggggtcggcccgaggtcggtaggaaagcgagtgaggtgggacgggtagaacgggaaagtacgtagtcgggacgtacttcggtgggtacgggaaacggggccttaacgttacccaaccgttacccgttaccgaagtaacgaaaccaaactaactaacgaaaacgaaccttaactaaattcggtaaaccttaccttaaaccaaaattcgggaacaaccgacggtaccctaacgaacgttaaccgacccgggaaagggtaacccgaccggggttaccgttaacgtttaacgttaaccggttggtacgggtaaccggtaaggtttccgtttaggggtttaaggagttttacggttggttccgttacgtccgacccgttacgg

SEQ ID NO: 302707 - DNA, 531 bp, Homo sapiens
  misc_feature: GZ8MTXP02FHWK0.52.78.H01.1.454.CMB.2.raw
  modified_base (285)..(285): a, c, t, g, unknown or other
  misc_feature (285)..(285): n is a, c, g, or t
  modified_base (489)..(489): a, c, t, g, unknown or other
  misc_feature (489)..(489): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctctggattcacctttaanagttatggatgacttgggtccgccaggctccgagggaaggggctggagtgggtgccagcgtgaagcatgagtggaggtgaggaagactagtgcggactcgtgtgaagggccgattcaccacttcccagagacaacatacaaagactacaatgtatactacaaatgagcagcctgacacgtccgagacgacggccgtgtattacngtcgacgtagagtttcgtggtattgttgtcgttcgctacacg

SEQ ID NO: 302708 - DNA, 663 bp, Homo sapiens
  misc_feature: GZ8MTXP02JM34H.52.78.H01.1.454.CMB.2.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctnaggacagacggccaggatcacctgctctgganatgcactgaccaaagcaatatggttatggtaccagcagacggccaggccacggtcccccttagtcggtagatatataatgaccatgacgacgccctgaggactcccgtgacgcgtactcgtcgtcggtccctcccgtctaccgacgggtaacaacgtacggtacctaccgttagaacgtactaacgttccgaagggttacgggaacggttccccggggagaacgggtaaccggggaacggaaacggggtccttaaggtaaccctttaagttaccgttagtaaaccaaacgttactaaaacgtaccggaaacgtacggttaaggttaccgttaacgttaagtggtaacgtaccggttaaggttccgggggaacgggtaaccggtaaccgaacggtacccgg

SEQ ID NO: 302709 - DNA, 519 bp, Homo sapiens
  misc_feature: GZ8MTXP02GIJKT.52.78.H01.1.454.CMB.2.raw
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatntggttattggtacagcagaggccaggccacggcccccttatggtgatatataaggaccatagagaggccctagagggatcccgtgagctattcctcgtcgcctcctcctcgaggtacaactgtacacgttgatcatcgagtggagtcccggnacggagacgagctagactatactgtacatacanagacagtagagttatagtgtnctaggtcggacgtaggacagctagaccgtgtaacgcacgccgacgactccgcccctacggctaccgttccg

SEQ ID NO: 302710 - DNA, 592 bp, Homo sapiens
  misc_feature: GZ8MTXP02GRIOO.52.78.H01.1.454.CMB.2.raw
  modified_base (224)..(224): a, c, t, g, unknown or other
  misc_feature (224)..(224): n is a, c, g, or t
  modified_base (416)..(416): a, c, t, g, unknown or other
  misc_feature (416)..(416): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttattggtaccagcagagccaggccacggccccttagtggtagatatataaggaccatgagacgccctcgagggactcccgtgagcgtattccctcgtggtcctcctccgtcgacgggacaacgacgttccgacgttagactactacgtcgaggtcggacgtccggganaaggacggacggaggctaggtactagttaccgtagtacaactacaacgtagacgagtaggtagttacttagtggtagtacgtaggttcgggacggacgggacctaaggcgtacggacccgttaccgtaggtcccgacgacccgacggtcccgtcccggacccccgtacggtccccg

SEQ ID NO: 302711 - DNA, 562 bp, Homo sapiens
  misc_feature: GZ8MTXP02IZIH3.52.78.H01.1.454.CMB.2.raw
  modified_base (313)..(313): a, c, t, g, unknown or other
  misc_feature (313)..(313): n is a, c, g, or t
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
  modified_base (538)..(538): a, c, t, g, unknown or other
  misc_feature (538)..(538): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtggggggagcttggtccagccgtggggggtccctgacactctcctgtgtacgcctctggtattcaacctttacagttagttggatgtacttgggcccnccaggctccgagggaggctggagtgggtgcccaggcgtgagcagtgagtggagtgaaggaagctagtggcgactcgtgtaggacgggccgtattccaccgtaccttcaaggacgaacaacacgtacaaagactanaatgtactcgaaccaaagtgacgcacgctanacacgtcgaagctacggcgttagtaattcgagttggacgtagtacgtttcggttaaggntttggttacgtgtcaccgtacctg

SEQ ID NO: 302712 - DNA, 574 bp, Homo sapiens
  misc_feature: GZ8MTXP02FF5O9.52.78.H01.1.454.CMB.2.raw
  modified_base (406)..(406): a, c, t, g, unknown or other
  misc_feature (406)..(406): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtacagcagaggccaggccacggcccccttagtcggtgatatataaggacagtgagacggccctcgagggactcccgtgagcgtattcctcgtcgctcctcctcgagggtacaacagtcgtacgttgatcatcgaggtgacggtccggganaggaggacggaggccgtgaaccttagttaacgtgtacaatccaaacaggtaacagttaggtaggttaacttagtgagtcgtaggttcgggacgggagggaaccagcgtacgaccgtacgtacggggtcaacggacccgacggtccgtaccggtcccccgtcggtaccc

SEQ ID NO: 302713 - DNA, 654 bp, Homo sapiens
  misc_feature: GZ8MTXP02GX8JK.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtggaggcgcagctggtggagtcgtgggggaggcttggtccagccgtgggggtccctgacactctcctgtgtagcctcgtggacttcaacctttaaacagttaattggatgtacgttgggtcccgcgaggcctaccgaaggggaggggctaggaggtggggtcggccaggcgtagaagcagtgagtggagtaggaacggaagactagtcggacgtactgtgggtaggaacgggccgtattaccgaccctaacttacccgaagtagaaaccaaacacgtacaaacgtaactacgaattagtaactccaaaccgtaaatcggagaccgaaacgtccctaggaaacctagggacccgaaacgggtaccgtacccgggtaccgtttaagttaacgttacgttgggaccggacggtaagttccgtttttcgtggggtactttggttcgtcgttacggacctacgccgg

SEQ ID NO: 302714 - DNA, 576 bp, Homo sapiens
  misc_feature: GZ8MTXP02IYWB7.52.78.H01.1.454.CMB.2.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (432)..(432): a, c, t, g, unknown or other
  misc_feature (432)..(432): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcncagctgggtggagtcgtgggggagtcttggtccagccgtggggggtccctgacactctcctgtgtacgcctntggattcactttacagttattggatgtacgttgggtccgccaggctccgaggggagggctaggagtggggngccagcgtgagcatgatgggagtgacgganactntggcgactcgtgtcgggaagggtcgactccaccacttacgaagacgaacaacatanaaacgtaacacaatgtaactcactaaatgagcacgactagactacgacgacgaccgtacgggtaccgtgttacttacggtgtacgacggttagtaggtttcggtttaaggtgtttggtttacggtggtttcaccgtaacgtccg

SEQ ID NO: 302715 - DNA, 544 bp, Homo sapiens
  misc_feature: GZ8MTXP02GYW26.52.78.H01.1.454.CMB.2.raw
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaatatggttatggtaccagcagaggccagccgacggcccccttatggtagatataagtaagaccatgagacggccctcgagggctcccgtgacgcgtattctctggcctcctcctacgaggacaacagtcacgttgatcatcgagtgggtacgccgggnaacggagggacgagggtccaggaccttaattactgtacaatacaaanagagagtagtagtattagtgtacgtcgtacggtacggacggaacggaacgaacgacgtacgtaccgtaccgtacggtacg

SEQ ID NO: 302716 - DNA, 563 bp, Homo sapiens
  misc_feature: GZ8MTXP02GFG77.52.78.H01.1.454.CMB.2.raw
  modified_base (223)..(223): a, c, t, g, unknown or other
  misc_feature (223)..(223): n is a, c, g, or t
  modified_base (371)..(371): a, c, t, g, unknown or other
  misc_feature (371)..(371): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtgganatgcactgaccaaagcaatagtggttattggtacagcagaggccaggccacggtccccttagttggtagatatagtaaggaccatgagacggcctcgagggtactcccgtgacgcgtattctcgtcggcctcctctcgaggaccaacngtcacgttgactcatcgagtgcggtccggagaggaggacgacggctagacttattactacgtacaactacaaacgagtacgtaggttagtagttacgttagtggtacgcgtaaggtcggacggtaacggacgaggcgtcgacgtccgtacgtcgacgaaccgagtccgtccgcccgtcggtctacgttcccg

SEQ ID NO: 302717 - DNA, 576 bp, Homo sapiens
  misc_feature: GZ8MTXP02FMPDT.52.78.H01.1.454.CMB.2.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggagcttggtccagccgtgggggtccctgacactctcctgtgagcctctggattcacctttaacagttattggatgacttgggtccncaggctccgagggaagggctggagtgggtggccagcgtgaagnatgagtggaggtgaaggtaagacttatgcggactgtgtagaagggccattccacctactccaagacgaacaacatacaaagaactcaatgatcacgaatgacncancagacacgacgagaccgacggtcgttagttacgttacgtggtacggtacgtaaggttacggtttcggtttaaggggtacgtttcgggtttcggttacccggttacgaccccgtacggacg

SEQ ID NO: 302718 - DNA, 563 bp, Homo sapiens
  misc_feature: GZ8MTXP02FIWQ8.52.78.H01.1.454.CMB.2.raw
  modified_base (521)..(521): a, c, t, g, unknown or other
  misc_feature (521)..(521): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctctcactctctgcacaggctctggggcctcctatgaactgacacagccaccctcggtgtcagtgtcctcaggacagacggccaggatcacctgctcgtggagatgcactgaccaaagcaatatggttattggtaccagcaggagccgaggccacggtcccccttagtggtcatatataaggaccatcgagacgcctcgagggactcccgtgacgcgtattctctggcctccctcctcgacggacaacgagtctacgtgatcatcgagtggacggtccggacgaggacggtacggaggtccgagtaacttattacgtcgtactagtacaaacgtagaacgtagtaggtacgttacttagngtacgcgtacggttacggacggacggtacgacgacgtaccgg

SEQ ID NO: 302719 - DNA, 629 bp, Homo sapiens
  misc_feature: GZ8MTXP02F11AR.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagacggccaaggccacggtcccccttagttcggtagtatagtagtaaaggaccagtagagacggaccccgtacgaggggtaacttcccgtagtacgcgtatttccgtcgtcggccttcccctacctccgaacgggaaccaacgcggtcaaccggttgaactctattcgagtgggacgtccgggcaggacggacgagccgtagactattactgtactaaatacaaactgaactagggtagtacggttaatttaagtgttacggagtacggttcgggacgggaacggaacgtaaacgcggttacgaccggttcgtacgggtccacggtaacccgacggtctacccggtcccccgtacggtcccacgtttcccg

SEQ ID NO: 302720 - DNA, 541 bp, Homo sapiens
  misc_feature: GZ8MTXP02HQTQD.52.78.H01.1.454.CMB.2.raw
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (522)..(522): a, c, t, g, unknown or other
  misc_feature (522)..(522): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacgccaggatcacctgctctggagatgcactgaccaaagcaatatggttattggtaccagcagagccagccaggcccctatggtgatatataaggaccatagagacggcctcgagggactccctgagcgtattctctcggctccgtcctacgaggggaccaanacggtacacgttgatctatacgaggtgagtcccgggnaggacggacgtaggctagacttattacagtanaactcaaagtaanagtagtagtagtatagtgtgagtaggtacggacggtacggacgagtcgacgacgtacgacgtacgacgaacgacgtccnccgcccgtcgtactactcg

SEQ ID NO: 302721 - DNA, 537 bp, Homo sapiens
  misc_feature: GZ8MTXP02FRSSS.52.78.H01.1.454.CMB.2.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagagccaggccaggcccccttatcggngatatataaggaccatgagaggccctcagggatccctgagcgatccnctgctcctctcaggcacatcagttgatnactcagtggacgtcgggcagacggacgaggctgtaactattactgtacaatacaacagaacagtagtaggttaacttagtgtagacgtagttcggggacgggtacggacgtaaagcgttcgaaccgtccgttacggcgacgacccgaacggccgtacgcccccgtcggtaccc

SEQ ID NO: 302722 - DNA, 745 bp, Homo sapiens
  misc_feature: GZ8MTXP02FIMNG.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatagttggttattggtaaccagacgagacggaccgacggaccgaccggtcccccttaagttcggtagtattaataagtaaacggacctaagtaggaaggaaccggtccccgtacggacgggtacctcccgtaggacgacgtacttcgtacgtcggtccctccctcctacgacgggtaaccaagtacgtctacgttgactacacgtacgaggttacggggacgtcccggggagaacgggacgggaaccggacgggacgttagtaacgttaactttacgtagtaactaaactaccgaaacgagtaaaccgtaaggggttaacgttacggtttaagtttaggttaggtacggtacggtacggggtttaccgggggacggtaaaccggggtaacgaacggttacgggtaccggtaaccccgggtttcgttaaccgggccgtaaaccggccccggtaaacggtcccgtacccccggtcccccggttacggtacccctccgtttacccccgg

SEQ ID NO: 302723 - DNA, 634 bp, Homo sapiens
  misc_feature: GZ8MTXP02IFKYG.52.78.H01.1.454.CMB.2.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagcaatatggttatgtacagcagngcagcacgcccctatggnatatataagcatgagagcctgacgggactcccgtgagcgtacttcgtcgtcggtcctccgtcctacgacgggaccaaacgcgtctaccgttagacttccagttaccagggttacggacggcccggggagaacgggagggaacggagggtcctaggaccttaagttacgtggttaaacaacttaaccaaacgagtacgtaaggtagtacgttacttagttgtacgtgtaacggtcgggacgggaacggacgaacgggtcttacgggaccccgttacggtaacggttccgaaccggaacccggttaaaaccggccgtttccccggacccccgtccggtttccctaaccggtttcccccg

SEQ ID NO: 302724 - DNA, 584 bp, Homo sapiens
  misc_feature: GZ8MTXP02GGK7W.52.78.H01.1.454.CMB.2.raw
  modified_base (404)..(404): a, c, t, g, unknown or other
  misc_feature (404)..(404): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactcgaccaaagcaatatggttattggtaccagcagaggccaggccacggcccccttagtcggtgataatataaggaccatgagacggcctcgagggactcccgtgacgcgtatctcgtcggcctcctcctcacgggacaacacgtcacgttgatcatcgaaggtgaacggtccgganaggacggacggaggctggaattatacgtcgtactaaatacaaacgtagactaaggtagtacggttattagtgtagcctaggttcggacggaacgggaccgaaaggtcgtacggaccgtaccgtacggcaacgaacccggaacgtcctacccgggccccctacgggtcctaccgtttcccg

SEQ ID NO: 302725 - DNA, 583 bp, Homo sapiens
  misc_feature: GZ8MTXP02HWIP6.52.78.H01.1.454.CMB.2.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggnttggtccagccgtggggggtccctgacactctcctgtgtagcctctggattcacctttaacagttatggatgacttgggtccncaggctcgagggagggctggagtgggtgcagcgtgaagcatgagtgggaggtgaagganactagtggacggactcgtggtaggaacggggcctaattcccaactaccttccaaggacaacctaaacactaccgaaaanaactacaaagttntactacctaactaaagagacgacacgacgacgacacgacgacgacgacggtacgtacgttacgttacgtacgtacgtacgtacgtagttagttggtagttcgttcggttcgtcgtctacgtacg

SEQ ID NO: 302726 - DNA, 614 bp, Homo sapiens
  misc_feature: GZ8MTXP02IJGFX.52.78.H01.1.454.CMB.2.raw
  modified_base (318)..(318): a, c, t, g, unknown or other
  misc_feature (318)..(318): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaagtgtccagtgtgaggcgcagctgggtggagtcgtgggggaggtcgttggtccgaggcccgtggggggtccctggaccactcctcctgtgtagcctctggattcacctttaacagttattggatgacgttgggccnccaggctcgagggaggggctggagtggggtgccagcgtgaagcagtgagtgggagtgaaggaagactatggcgactcgtgaggaagggccgtattccacctacttaccgaagacaacgaacatacaaagaactacaattgtatacctaccaaaatcgaacgacacgcctagactacgaccgggaacgacgaaccgggtccgttattacgttaacgttggtacgaccggtaagttaccgtttttaggttggggtagttttggtttcggtttccggtttacggacccaaccggtccgg

SEQ ID NO: 302727 - DNA, 735 bp, Homo sapiens
  misc_feature: GZ8MTXP02GMNFC.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctcgtggggcctcctatgaactgacacacgcccaccctcggtgtcagtcgtcctcgaggacaggacggccaggactcacctgctcgtggagatgacactgaaccaaagctaatagttggttagttcggtacagacaggacgccgacggccacggtccccttagtggtagatataagtaacgacagtagagtacggccctacgaggtactccgtagagcgtattccctcgtcggtcctccctacgtacgacgggtacaacgacgttaccgtacgttgaactctaacgtccgtaagggttcggacgggtccggggaacgaaggggacgggaacccggaggtacgttaacggtaacttaacgtttaaacggtcttaaaccgaaacttaaccgaaacgaacggtaaaccggtaaaggtttaacggttaagggtttaaactttaggttagttacggtacggtaacggggttcgggggaccggggtaaaacggggaacccgttaaaggcccgtaaccggtacccggtaaccggttacgaaccgggaaccgtaccccggaacgggtccccgtcccggttacccccgtacgggttaacccc

SEQ ID NO: 302728 - DNA, 673 bp, Homo sapiens
  misc_feature: GZ8MTXP02IQH88.52.78.H01.1.454.CMB.2.raw
  modified_base (349)..(349): a, c, t, g, unknown or other
  misc_feature (349)..(349): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaacatggagttggggctgagcgttgggttttccttgttgcttattttagaaggtgtccagtgtgaggcgcagcgtgggtggagttcggtggggggaggtcgtttggtccgacggtcccggttcgggggggtcccctggacctacctcttccgtggtgtacgcccttgtggactttcctaacctttaactagttattggatgtacgttcgggtcccncgaggcctaccggaggggaacggggtcgtgggaggtggggtcggccgaggcggtagaagcagtgtagtggggaggtgaaggaagtacgtagtcggacggtactcgtggtagggacgggcctacttcccgacctaccgttaccgaagacgaaaccaaacactaacaaacgtaactacgtaaattgtaactacctaaacaaatgacgactacgcctagaacctacgtacccgaagtaccgaccggtcgttacgttaaacgttccgttaggacgacggttagttacgtttggttaagggttcgtgtttcggtcgttcaccgtacgcg

SEQ ID NO: 302729 - DNA, 601 bp, Homo sapiens
  misc_feature: GZ8MTXP02ISTF7.52.78.H01.1.454.CMB.2.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (591)..(591): a, c, t, g, unknown or other
  misc_feature (591)..(591): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctgggtggagtcgtgggggaggcttggtccaggccgtggggggtccctgacactctcctgtgtagcctcgtggattcacctttaacagttatggatgtacgttgggtccnccaggctcgagggaggctggngtgggngccagcgtgagcatgagtggagtgaggaanactagnggcgtactcgtgtaggaggccgtatcacctacttaccagataaccaacagtacaaagtaactacaattgtaactcctaacctaaaagtcggaagacccacgtacccttagaacctaacgaccccggtaagggaacccgtccgggtaccgttaggttactacgtggtcgaccggtagttacggtttcgttaagggtagtttggttacgttcgttacnccgaactcgg

SEQ ID NO: 302730 - DNA, 642 bp, Homo sapiens
  misc_feature: GZ8MTXP02HE4AV.52.78.H01.1.454.CMB.2.raw
  modified_base (611)..(611): a, c, t, g, unknown or other
  misc_feature (611)..(611): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagcctcgtggattcacctttaacatttatggatgtacgttgggtccgccgaggcctccggaggggaaggggctgggaggtgggtggccgtaggcgtgaagcatgacgtgggagtgaggagactagtggcggtatcgtgtaggtaacgggccgtaacttcgaccctaccttacgaggacaaccaaacacgtaacaaacgaacctaagaattacggtacttacctaaccctaaagtacgacgaccaacggtccccaaggaaacctacgtacccggaacgggaacccgaccgggtacccgttagttaaccgttacgtaggacggcggtaaacgtggttttcgttaagggtntttcgggttgttcgggttacgccgtacgtcg

SEQ ID NO: 302731 - DNA, 756 bp, Homo sapiens
  misc_feature: GZ8MTXP02I3BAL.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcactgctctggagatgcactgaccaaagcaatatggttatggtacagcagaggccaggccacggtcccccttagttcggtagtaagtaataagtaacggaccagtagaagacggccctacggacgggtaactccccgtaggaacgtcgtaactttccgtctccgggtccttcccgttacccgtaccgacggggaaaccaaccgtacggtacctaacggtttacgtaacttacctaacgtaccgtaaagggttacggggaaaccgggttcccgggggaaccgaaaggggaacgggtaaaccggagggtcccgtagtaaccgttaattaccgtaggttaacaaacttaaccgaaaacgacgtaaaccgtaaggttaacggttaaccgggttaactttaaggttcgtacggtaccgtaacgggtttaccggggacgggttaaacgggaaccttaaacggccgttaacggtacccggtaccgttaacggtacgacggaacccgtaaagggtaccctacccggtacccccgtccggtacctaacggtttccccg

SEQ ID NO: 302732 - DNA, 754 bp, Homo sapiens
  misc_feature: GZ8MTXP02H1T7J.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgacaaagcaatatggttatggtaccagcgagaggccaggccgacggtcccccttagttcggtagactaataataaacggacctaagtggaaggacggcccctacgagggactcccgtagacgacgtacttctacgtccggtccttccctaccgtacgtacggggtaaccaaacgtacgttaccgtaacggtttacggaacttacctaacgtaccgtacggggtacgggtaccgggttacccggggacgaacggggaacgggaacggggaacgggtcgtagggtaaaccctttaagttaccgtacggttaactaaaccttacgaaaaccgtaagtaaacgtaagggttacgttagggttaactttagttacggttgaacgttacgggttaccggggacgggtaacggggaaaccgtaacggtaccggttaacggtacccggttaccggtacggtaccgaaccggtaacccgtaaacggtcccgtaccccggtaccccggtccggttacccgtacccgttcccccgg

SEQ ID NO: 302733 - DNA, 707 bp, Homo sapiens
  misc_feature: GZ8MTXP02HT3QT.52.78.H01.1.454.CMB.2.raw
  modified_base (430)..(430): a, c, t, g, unknown or other
  misc_feature (430)..(430): n is a, c, g, or t
  modified_base (614)..(614): a, c, t, g, unknown or other
  misc_feature (614)..(614): n is a, c, g, or t
  modified_base (656)..(656): a, c, t, g, unknown or other
  misc_feature (656)..(656): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgttgggttttccttgttgctattttagaaggtgtccagtgtgaggcgcagcgtggtggagtcgtgggggaggtcgttggtccgaggcccggttcggggggtcccctggacctactcctccgttgtcgtacgtccttcgtggtacttcctaaccctttaaacgtagtttagttggtaattgtacggtttcgggtccgaccgtaggccgttaccgggaagggggaacggggcgtaggggaggttcgggggtcggacccgtaggtcggtaggaaacgtntaggttaggaagttaggggaggtaggaaacggaagtaacgtagtcggacgtactcgttaggacggtaacggccgtacgttacccaacccgtacgttaccgaagaacgaaacctaaacagtaacgaaaagtaacctataaagtagtacttacctaaacgtaaatggaccgacgacgtacccgtanaaccgcgtaccggagaccgtaaccgggtcttaagttacgacnggtacgacgtagttcgttgttaaggagttcgttcgtacgtcgaactccgcg

SEQ ID NO: 302734 - DNA, 701 bp, Homo sapiens
  misc_feature: GZ8MTXP02FLX7P.52.78.H01.1.454.CMB.2.raw
  modified_base (294)..(294): a, c, t, g, unknown or other
  misc_feature (294)..(294): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcacctgctctggagatgcactgaccaaagcaatagttggttattggtaccagcagacgcacggccgaccgtccccttatggngaatactaagtaacggaaccagtaggacggacggccctaggaggtacctcccgtagacgtacgtacttcctccgtcgtcccttcctccgtacgaacgggtacaaacgcgttaccgtaacgttgaactctagtacgacggttcggaacgggtccgggacgaagggacgggacggaggacctggtaaacttacgttagtactacaatacaaaccgtagaacgtaggttagtacggttaattaggtgtacggttacgtacggggttacggggtaacggaaccgggaaaccgtaacggcccgttaaccggggtacccgtttacccgttaaccggggaaccggttaacccggaaaccccggtaccgggtccccgtaacccccggtccccccgggttaaacggtttacccccg

SEQ ID NO: 302735 - DNA, 604 bp, Homo sapiens
  misc_feature: GZ8MTXP02J2W3U.52.78.H01.1.454.CMB.2.raw
  modified_base (279)..(279): a, c, t, g, unknown or other
  misc_feature (279)..(279): n is a, c, g, or t
  modified_base (469)..(469): a, c, t, g, unknown or other
  misc_feature (469)..(469): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagagcaggccaggcccctatgngatatataggacatgagacggccctgagggactcccgtgagcgtatctcgtcggcctcctcctacgaggaccaacgcgtctacgttgatcatacaggtgaacggtccggacgaaggacgggacgacgggctaggtaactaagtttactcgtaacaatacaaacgagaacagttaagtcggtaatttaagngttcgacgtaggtacgggacggtaacggggaaccaaaggccgttacggacccgttacgaacgggttaccgaaccggaacccgaaccggggttacctacccggtaccccccgtcggttaaccctacctttccccgg

SEQ ID NO: 302736 - DNA, 659 bp, Homo sapiens
  misc_feature: GZ8MTXP02GAI9J.52.78.H01.1.454.CMB.2.raw
  modified_base (419)..(419): a, c, t, g, unknown or other
  misc_feature (419)..(419): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacatagcccaccctcggtgtcagtcgtcctcaggacagacggcaggatcacctgctctggagatgcactgaccaaagctaaatatggttattggtaccagcagagccaggccacggccccttatggtgatatataaggacatcgagcggccctagagggactcccgtagagcgtacttcctctcggcttcccgttccaccgaggggaccaacgtagtccacgttgaattccaattcgagtggtacgtccgggganagggaaggaccggtaaggcttaggaaccttagtttaaaccggttagtaaactaaacgtacgaaaacgtaacggaaacgttaacggttaagggttaacgttaacgttaaggtacggttacggtacggtacggggttacggggacggggtaaacggaaccgtaacggtacgtaccggtacccggtacgtaacggaacgtaccggaaccgacggtacccgtacccggtaccccgtacgtaccg

SEQ ID NO: 302737 - DNA, 606 bp, Homo sapiens
  misc_feature: GZ8MTXP02GBTJU.52.78.H01.1.454.CMB.2.raw
  modified_base (279)..(279): a, c, t, g, unknown or other
  misc_feature (279)..(279): n is a, c, g, or t
  modified_base (406)..(406): a, c, t, g, unknown or other
  misc_feature (406)..(406): n is a, c, g, or t
  modified_base (484)..(484): a, c, t, g, unknown or other
  misc_feature (484)..(484): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctggtggagtcgtgggggaggtcgttggtccagccgtcggggggtccctgacactctcctgtgtacgcctctggtnttcaacctttaacagttattggatgtacgttcgggtcccgaccgaggcctccggaaggggaggggcgtgggaggtggggtcgccgaggcgtagaagcagtgagtgggaggtgaaggaacacgttagnggacgactgtaggtaggaacggccgtaattcccgaacctcttaccaggaacaacaacatacaaagactacaatcgtanctacgaaatcgagctagccgtacacgacgtacgaggacaccgggtcttaagtacttacggagtcggacgtaggtacgtttcgtttaagggtacttggttacggtgttccgactacgtaccgg

SEQ ID NO: 302738 - DNA, 566 bp, Homo sapiens
  misc_feature: GZ8MTXP02FH2SN.52.78.H01.1.454.CMB.2.raw
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctcgtggagatgcactgaccaaagcaaatatggttattggtaccagcagagccaggccacggccccttagtcggtgatatagtaacgaccatgagnggccctagaggactcccgtgagcgtatcctctgctcctctcagggacacgagtcacgttgactcattacaggtggacgtccggganaggaggacggaaggctgaacttacgttacgtgtacaactacaaacgtagacaggttaagtagttacgttataggtcgtacgtaggttacgggacgggtagggaacctaaggcgttacgacccgtcgttacggcgacgaccgtaacggctcccgacccgttcggtaccc

SEQ ID NO: 302739 - DNA, 704 bp, Homo sapiens
  misc_feature: GZ8MTXP02HFJHI.52.78.H01.1.454.CMB.2.raw
  modified_base (393)..(393): a, c, t, g, unknown or other
  misc_feature (393)..(393): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtggaggcgcagctggtggagtcgtgggggagcgttggtccagccgtgggggtccctgacactctctgtgtagcctctggattcacctttaacagttattggatgtacgttgggtccgccaggtcctccggaaggggaaggggcgtggaggtggggtcggcccgaggcggtagaagcagtgagtggaggtgaggagactagnggacgggtactcgtgtacgggaacgggccgtacttccgaaccctaccgttaccgaacgaacgaacccaaaactactacaaaacgtaaacctacgtaaagttacggttaacttaccgtaacccgttaaaaagtcggaacgtaccgaacgtacccgtacgaaccgtacgttcccgggaaggtaacccgacccggggtaacccgttagttaaactttaccggttaagggttccgacggttaccgggttaaggttttccggtttaaggggtaacgttttggtttcgggttcgtcggtacccgtaaccgttaccgg

SEQ ID NO: 302740 - DNA, 661 bp, Homo sapiens
  misc_feature: GZ8MTXP02JHDR1.52.78.H01.1.454.CMB.2.raw
  modified_base (219)..(219): a, c, t, g, unknown or other
  misc_feature (219)..(219): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctctatgaactgacacagccaccctcggtgtcagtgtcctcaggacagacgccaggactcacctgctctgganatgcactgaccaaagcaatatggttatgtacagcagagcagccacggccccttatgtgtatatagtaagacagtagagacgtcctcgaggtactcctagacgtcgacttctcgtcgtcctccgtcctacgacggaacaacgtcgttactacgttgtactcctagtacgagggttacgggcggtacccgggacgtaagggacgggaacggacggtcgtacgtaacctttaggtacttcggtaataaacgtacaaacgtacgaacgtaaacgggttagttaacggttaacgtttagtaccggttgaccgttagggtacgggacggggttaacggaacctaaggtaccgtacggtaccggttaccgttaacgggaccaccggtaacccggaaacggtcccgtacccggtcccccgttaccgtttacccggacctttttcccccgg

SEQ ID NO: 302741 - DNA, 716 bp, Homo sapiens
  misc_feature: GZ8MTXP02FFI5E.52.78.H01.1.454.CMB.2.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatntggttattgaccagnagaggcagccacggccccttatggtgatataagtaagaccagtagagacggccctcgaggactcccgtggacgtcgattctcgtccggtccttccctctcgaacgggtaccaaacgtagtccgtaacggttagtacttacaacgtaccgagggtttacggggaaacgggttcccggggacgaaacgggaagggaaccggacggcgttaacggtaaaccttattaacccgtggtaaccctaaagtacaaaccgaagtaacgttaaggttaaggttaccggtttaactttaagtcgggttacgaccggtacggggtttaccgggacggggtaacggggaacccgtaaaaggtcccgtacgggtaaccccggttaccgttaacgggtaccgtaaaccggaaccccggaaacggtcccgtttacccggccccccgttacgggtaacccgtaccctttccccgg

SEQ ID NO: 302742 - DNA, 668 bp, Homo sapiens
  misc_feature: GZ8MTXP02H7IRP.52.78.H01.1.454.CMB.2.raw
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcacatggagttggggctgagtcgttgggttttccttgttgtcttattttagaaggtgtccagtgtggaggcgcagcgtgggtggagtcggtgggggagtcgttggtccaggtccggtgggggtccctgacacttctccgtgtgtacgccttcgtggtacttcctacctttaaactagttattagggaattcgtacgttcggggtcccgaccgtaggcctaccgggaaggggaacggggcgtaggggaggtcggggtcggacccaggtcggtagaagcagtgagtgggaggtggaaaggacgactagtcgacggtatcgtaggagacgggctatccacctactccaaggacaacaaactanaacgaaanactactaagtacgtactacaaacgtaagtcgagacacgtccgagtacgaaccgaccgggaacgaccgtcggtacttacgttaactacggtacggacggtacgttacggtttacggtttcggtttaaggtacgtttcggttaccggtcgttaccgaccgtaaccgtccg

SEQ ID NO: 302743 - DNA, 614 bp, Homo sapiens
  misc_feature: GZ8MTXP02I14FN.52.78.H01.1.454.CMB.2.raw
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgctattttagaaggtgtccagtgtgaggcgcagctgggtggaggtcgtgggggagtcttggtccagccgtggggggtccctgacactctcctgtgtacgcctntggattcacctttaagagttagtgatgtacgttgggtccncaggctccggaaggggagggctggaggtgggtcgccgagcgtagaancagtgagtggagtgaggagactagtcggcgactcgtgtagggacggccgtacttacgaccctactcccgaagacgaacaacatacaaagactacgattagtactcctacaaatcgagtacacgcctagaccgacgtcccggaagaccgaccgggtactacgtttaacgttccgtaggtcggtaccgtaggttaacgttttcgggtttaagggtcgtttagggtttcgtacggttccgtacgaacccgttcccgg

SEQ ID NO: 302744 - DNA, 689 bp, Homo sapiens
  misc_feature: GZ8MTXP02HQ6ME.52.78.H01.1.454.CMB.2.raw
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (562)..(562): a, c, t, g, unknown or other
  misc_feature (562)..(562): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccacctcggtgtcagtcgtcctcaggacagacggccaggatcacctgctcgtggagatgcactgaccaaagctaaatattaggttattcggtaccagcaggacggcccacggccgaccggtccccctttaagttcggtagtaacttaagttaagaaacggtaaccagtaggaaggaccggccctacgacgggactcccgtagagcgtatctcgtccgctccctcacgtaggaccaacncgtactacgtgactanagtactggtacgggacggtccgggacggaacggacgggaacgtacgggtacgtaggtaactttaacggttacttacgtaaactaacgttaaacccaaagttaacgagtaaggtacggtttacgttaacgttagttacggngtcggttacggggtacgggacggggtacggtaaccgaaacggtccgtaccggtaccgtaccggtacgggtaccaccggaacccgaacggtcccgtccgacccccgtcgtaccgttaccgtttccccg

SEQ ID NO: 302745 - DNA, 633 bp, Homo sapiens
  misc_feature: GZ8MTXP02HYGAX.52.78.H01.1.454.CMB.2.raw
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagcgtgggtggagtcgtgggggaggcttggtccagccgtggggggtccctgacnctctcctgtgtagcctctgattcacctttaacagttatggatgacgttcgggtccncgaggcctccgaggggaggggctggaggtgggnggccagcgtgaagcagtgagtgggaggtgaagggagactagtcggcggtactcgtggtaggaacggggctacttccgaacctacctccaagaacgaactaaacgactaacaaagaacctanaaactagttacncctacgaaaatgaagcaacggccctaaggacctacgtcccggaaggacccgaacggggcccgtttaggtaacgttaccgtcggtaagtccggtaaaggtcgtttacggtttggggactttcggggtttcggtaccgtttcggacctaaccccgtcgg

SEQ ID NO: 302746 - DNA, 527 bp, Homo sapiens
  misc_feature: GZ8MTXP02IGWTR.52.78.H01.1.454.CMB.2.raw
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
  modified_base (422)..(422): a, c, t, g, unknown or other
  misc_feature (422)..(422): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtacagcagagcaggccaggcccctatcggtgatanataagaccatgagaggcctcaggactccctgacgcgattctctcggtcctcctcctcgacgggacaacacgtcacgttgatcancgagtggacgtccgggcgaaggaggacgaggctgacgtattacgtgacatanaacagacagtaagtggtactagtgtcgntaggtcgnggaacgggacaagcgtacgaccgtcgttacggcagcccgaaacggcctcgccccgtcggtctacttccg

SEQ ID NO: 302747 - DNA, 518 bp, Homo sapiens
  misc_feature: GZ8MTXP02I2VO9.52.78.H01.1.454.CMB.2.raw
  modified_base (399)..(399): a, c, t, g, unknown or other
  misc_feature (399)..(399): n is a, c, g, or t
  modified_base (444)..(445): a, c, t, g, unknown or other
  misc_feature (444)..(445): n is a, c, g, or t
  modified_base (504)..(504): a, c, t, g, unknown or other
  misc_feature (504)..(504): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccaggccccttatgtgatatataaggaccatgagaggcctcgaggactccctgacgcgtacttcctctcggctccctctcgagggacaacagtcacgttgatcactcagtggacgtcggcaggagacgngctagactatactgtacatacacagaacagtagtcgtatatgtgnnggttcggacggtaggacaacggactcgaaccgtcgacggtccacgtccgaacgcgaccnccccgttcggtacc

SEQ ID NO: 302748 - DNA, 585 bp, Homo sapiens
  misc_feature: GZ8MTXP02F6KU0.52.78.H01.1.454.CMB.2.raw
  modified_base (275)..(275): a, c, t, g, unknown or other
  misc_feature (275)..(275): n is a, c, g, or t
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccacctcggtgtcagtgtcctcagacagacggccaggatcacctgctctggagatgcactcgacaaagcaatatgttatgtaccagcagacgcagcacgccctagtgnatatataagacatagagacggcctgaggctccagcgtacgattctcgtcggtcctcctcctacgacggaacaacgtcgtacactagttnactcaagtacagggttagacggacgggacaagggagaccgagngtacgtactagtactagtcaaagtaccaaagagaactaggtacgttaggttaacttagttgtacgacgtacggttacggacgggacgggaaccgaaacgtcgtaaccgtaccgtaccgttaaggcgaacccggtcgaaaccgttccggacccgtccccgttacggtcccgtttacccg

SEQ ID NO: 302749 - DNA, 692 bp, Homo sapiens
  misc_feature: GZ8MTXP02GH0FI.52.78.H01.1.454.CMB.2.raw
  modified_base (224)..(224): a, c, t, g, unknown or other
  misc_feature (224)..(224): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggatcacctgctcgtgganatgcactgaccaaagcaatagtggttattcggacagcagaggcacggccacggtccccttagttggtagataagtaagtaacggaccagtagacggacgaccctacgacggactcccgaggacgtacgtattcgtcgtcggtccctcctccgtaccggaacggacctaacgtcgtaccgtacggttacgtacgtctacgtacgtaggtcgggtaacggtcccgggagaacggacggaacggtaggcgtacgtaacttattacgtagttaacaactacaaacgtagaacgttaaggttaaggttagttaacgttagtaggtacgacgttacgggttcggggacgggtaaacgggaccgtaaacgggtccgtaacgggaacccgttaccgtaaccggtaccgaaccggtaaccggtaaacccggtccgtacccccggtacccccgtacggttacccgtacctttccccgg

SEQ ID NO: 302750 - DNA, 745 bp, Homo sapiens
  misc_feature: GZ8MTXP02F12VX.52.78.H01.1.454.CMB.2.raw
  modified_base (223)..(223): a, c, t, g, unknown or other
  misc_feature (223)..(223): n is a, c, g, or t
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctctgganatgcactgaccaaagcaatatggttatggtaccagcagagccaggccaggcccccttagttcggtagataatagtaaggaccagtgagacggccctcgaggactcccgtggagcgattctcgtcggtcctccctcctacgtacgggaaccaacgtcgtacacgttagacttaccgtatcgagggttacgggtaacgggttcccggggacgaacggggacgggtaaccgggaacggacccgttagtaacggtttaactttaaccgtaggttaaccctaaacttaaccgaaacgaaacggtaacccgttaaggggttaaaggtttacggtttaaaccgtttaaacgttggtttacgggaccgttaaacggggttttccgggggaaccgggggaaacgggtaacccgtaaaaggtccggttaaccgggtaacccgttaaccggtaccgggttacgaaaccgggtaacccgaaacggtacccgtccccggtaacccccgtaccgggttcctaaccgtttcccccgg

SEQ ID NO: 302751 - DNA, 700 bp, Homo sapiens
  misc_feature: GZ8MTXP02G1SAK.52.78.H01.1.454.CMB.2.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcgaggacagacggccaggatccacctgctcgtggagatgcactcgaccaaagcaatagtggttattggtacagcagacggccaggccacggtccccttagttcggtagatataagtaaggacagtaggacgtacggcctacggacgggacttcccgtaggacggtacgttacttcgttcgtcccggtccctttccgtaccgtacgaacggaaccaacgtcgtaccgtacgttacgaactcgtaacgtcgaaggtcgggtacggtcccgggagaacgggaacgggtacggacggtcgtacgtacgttaacgttacgtacgtaactaaacgtaaacgaacgtaacggtaacgtaagggtttagttacgttaacgttaaggtggttacggacgttacgggtacggggaacgggtaacgggaacgtaacggtccgtaacgggtaccgttacgtaacggtcgaaccgaaccgtacggtcccgtacccgtccccgtacggtccctacgtttccccg

SEQ ID NO: 302752 - DNA, 664 bp, Homo sapiens
  misc_feature: GZ8MTXP02FEXJ1.52.78.H01.1.454.CMB.2.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggactcacctgctctgganatgcactcgaccaaagctaaatagttggttattggtaccagcagaggccaggccacgtccccttatcggngatanataaggaccatagagacggccctacgagggactccctgagtccgtattcctcgtggctccctctacgacgggacaacgacggtctaccgttanactactagtacgtaggtacggacggtaccggagaacgggacggacggtacggtacgtagtaaccttaagttaccgtacgtaacctaactaacgaaacgagtaacgtaacggttagttacggttaactttagtacggtacgtacgtaacgggttaccggggaacgggtaacggaaaccgtaacggtaccgtaaccgtacccggtacgttaaccggaaccgaacccgtaacccggtacggtccccgtaccccggtacccccgttacggtacccg

SEQ ID NO: 302753 - DNA, 795 bp, Homo sapiens
  misc_feature: GZ8MTXP02GQPFC.52.78.H01.1.454.CMB.2.raw
  modified_base (352)..(352): a, c, t, g, unknown or other
  misc_feature (352)..(352): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacgctcggtgtcagtgtcctcaggacagacggccaggactcacctgctcgtggagatgcactcgaccaaagcaatatggttattggtaccagcgaggacggccgacggccaccggtccccctttagtcggtagtactataagtaacggaccataggagacggccctacgagggactccgngacgcgtacttctcgtcggtccctacctcccgtacgacgggtaaccaacgtacgtaccgtacgttagtactactaacgtacgtaacggtcggggtaaccgggtcccgggggacgaaacggggtaacggggtaacggacgggtaccgtacggtaaccgtttaaacgtttaacggttaacgtttaaccgtaacttaaccgaaaacccgtaaggtaaacccgtaagggtttaaacggttagggtttaaaccgttttaaggttcggttacggtacggttaaccggggttaccgggggaacgggggtaaacccgggggtaaaaccggtaacggtacccgggttaccgggtaaccccggtttaaccggtaaccgggttaacccggaacccggtaaacccccggtaacggggtcccccgttaccccggtttacccccccggtttacccgg

SEQ ID NO: 302754 - DNA, 527 bp, Homo sapiens
  misc_feature: GZ8MTXP02GR6PB.52.78.H01.1.454.CMB.2.raw
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (510)..(510): a, c, t, g, unknown or other
  misc_feature (510)..(510): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttatggtaccagcagagccaggccagccccttatgtgatatataggaccatgagaggccctcgagggatccctgagcgtattcctcgtgtctcctctcgaggaccaacagtcacgttgactacattcgagtggagtcccggganagaggacgaggtctagtattatacgtcgtanaacttnaaacaganaagtagtacggtattagtgtagcgtaggttcggaggtaggacctagcgtcgaccgtctagcgacgcctaggcnccgccccgtcggtaccg

SEQ ID NO: 302755 - DNA, 580 bp, Homo sapiens
  misc_feature: GZ8MTXP02FM85R.52.78.H01.1.454.CMB.2.raw
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (449)..(449): a, c, t, g, unknown or other
  misc_feature (449)..(449): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatattggttattggtacagcagaggccaggccacggcccccttagtggtgatatataagaccatgagngccctgagggactccctgacgcgtattctctgctccctcncgaggaacaaactactcacgttagaatactatcgagttaggggacgtcccgggagaacggaaggacgagggctagaacgttatactgtaacataacaacganaacgtaggtagtacgtaatagtgtgctaggtcggacgggtaacggacgacggacgtacgacccggtaccgttacgggacaaccggcccgaacggtccgtacccgcccccgttacggtccgactttccccgg

SEQ ID NO: 302756 - DNA, 648 bp, Homo sapiens
  misc_feature: GZ8MTXP02HEL5N.52.78.H01.1.454.CMB.2.raw
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagtcttggtccagccgtgggggtcctgacactctcctgtgtagcctctgattcactttaacagttattggatgtacgttcgggtccgaccgaggcctccggaaggggaacggggcgttgggaggtggggtcggcccgaggcggtagaagcagtgagtgggaggtgagggaagacttagcggcggtactcgtaggtaggaacggggtccgtaacttcccaaaccctacttaccgaaggaagaacccaaacgataaaccgaaagaaccctanaaagttanaaccttacaactaaaagcgaacgacacgccctagaaacctcggtccgaaaggggtacccacggggtacttagttaactaccggtgtacgacggtaagttcgtttggttttaagggactttggtttacgttgtaccgaccgtaacgtcggg

SEQ ID NO: 302757 - DNA, 745 bp, Homo sapiens
  misc_feature: GZ8MTXP02HG780.52.78.H01.1.454.CMB.2.raw
  modified_base (222)..(222): a, c, t, g, unknown or other
  misc_feature (222)..(222): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaagcaaatagtggttaagttcggtaccagcgaaggacggccaggccgacggtcccccttagttacggtagtataataagtaacggaccagtgagacggcctcgaggactcccgtgacgcgtattctcgtccggcctcctcctacgacgggaaccaacgtcgtaccgtaacggtttacgaacttcaacgtacgtacgggttacgggtaaccggggttcccggggacgtaaggggaacgggaacccgggagggttacccgtaagggttaaccctttaaagtttaccgtaacggttaaccgtaaaacgttacctaaaaacccggaaggttaaaccgtaacggggttaaagtttaaccggggttaattttaaacggtggttacgtacggttaacgggttaccggggacggggtaaacgggtaccgaaaggtccggtaacggtaccggttaaccgtacggttacccgaacgtcccggaagtcccgtcccggtacccgtaccggtctaccgttcccg

SEQ ID NO: 302758 - DNA, 585 bp, Homo sapiens
  misc_feature: GZ8MTXP02IU9JS.52.78.H01.1.454.CMB.2.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtcgtcctcaggacagacggccaggatcacctgctctgganatgcactgaccaaagcaatagtggttatgtaccagcagacggcaggccgacggccccttagttggtagatatataagacagtgagagccctgagggactcccgtgagtacgtatctctcgacctcctcncgaggacacgngtctagtanactcatcagtggagtacggnaaggacggagacggcgtagtaactagttactgtaacaaacgttacaactagaacgtagttaaggtagttaacttagtagtagtgtaacggttcgggacgggacgggaaccgaaggtcgtacggtacccgtacgtacggtacgaacgccggaacgtccgttacccgccccggttacgtaccgtacgtttccccg

SEQ ID NO: 302759 - DNA, 701 bp, Homo sapiens
  misc_feature: GZ8MTXP02FRROU.52.78.H01.1.454.CMB.2.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (406)..(406): a, c, t, g, unknown or other
  misc_feature (406)..(406): n is a, c, g, or t
  modified_base (477)..(477): a, c, t, g, unknown or other
  misc_feature (477)..(477): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagcgtggtggagtcgtagggggagcgttggtccagccgtggggggtccctgacactctcctgtgtacgcctgtggattctacctttaaanagttatggatgacgttcgggtccncgaggtcctcggaaggggaacggggtctgggtaggtggggtcggacccaggtccggtagaaagcaagtgagttaggggaggtagaacgggaanacgtagtcggacggacttcggtagaggggaacggtaccgtacttccaaacccgttaccttccgaaaagganaacccgaaaacacgttaaccgaaaacttaaacgtaccaaaattacggtaaacttacccaaaccgtaaaaggtcgtaaccgacacggtactaacggtaaccacggtacggaacgggacccgtccgggtacttacggtactttacggtagttacggacgttacggtttcgtttacgggttgggtacgtttcggtttacggttaccgttacgacccgtaaccggtcg

SEQ ID NO: 302760 - DNA, 658 bp, Homo sapiens
  misc_feature: GZ8MTXP02IBIWH.52.78.H01.1.454.CMB.2.raw
  modified_base (299)..(299): a, c, t, g, unknown or other
  misc_feature (299)..(299): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctctcactctctgcacaggctctggggcctcctatgaactgacacagccaccctcggtgtcagtgtcctcaggacagacggccaggactcacctgctctggagatgcactgaccaaagcaatatggttattggtaccngcagaggcaggcccacggtcccccttagttcgggtatacgtataaattaaacgggacctagtcgagaccggtccccacggaggggtaaccttccccgtgacggtaccgtacgtttccctcgtacgggcctttccctcccgtacgacggggaacccaacgtcgtactaccggttgactcaactcgtaggtaggcggtaccgggacgacgggagggacggacggtcgtacggacttaattacgttagtactaaataccaaacgagacgtaagttaccggtagtttaacgtaacgttggtacgtaacggttacggttaccgggggacggaacggggtaccgtaacggtaccggtaacccggg

SEQ ID NO: 302761 - DNA, 716 bp, Homo sapiens
  misc_feature: GZ8MTXP02IBPKS.52.78.H01.1.454.CMB.2.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtcgtcctcgaggacagcggccaggatcacctgctctggagatgcactgaccaaagcaatatggttatcgtacngcagagcgaggcacggccccttagtcggngtatagtataaggacctagtgaacgacggccctcgagggtactcccgtagacgacgtacgttctcgtcgggtccctccccgtaccgtacgaacggggaccaaacgtcggtaccttacggttacggtaaacttccgtaaacgtccgttaaagggccggggttaaacgggcccgggggagaaccgggaaaggggttaccgaaacgggtcgttaacggtaacgttaaccttacgtcggtaaactaaacttacccggtaaaaacgacgtaaacgtacggttaacggttagttaacgttagttcggtacggtacggtacgggtacgggaacgggtacggaaccgtacggtaccgtaccggtaccgttacgtacggtaccgaaccggtaacccggtaccgaccgtcccggtccccgttaccgtcctacccgttcccg

SEQ ID NO: 302762 - DNA, 731 bp, Homo sapiens
  misc_feature: GZ8MTXP02FXHV7.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctctcactctctgcacaggctcgtgggcctcctatgaactgacacagccacccgtcggtgtcagtcgtcctcaggacagaccggccaggatcacctgctcgtggagatgcacgtcgaccaaagactaatagttaggttagttaggtaccagcaggacggccgacggaccgaaccgtcccccttagttggtacgtagttaataagtaaacggaaccgtagtacggaacggaaccggtaccccgtaccggaacggggtaccgttaccccgtaaggtaacggtaccgttaacgtttccgttcgtcggtcccttccccgttccgttacggaacgggaacctaaaccgacgttaccgtacgttagactacgtacgtccgtaaggtacgggtacggtaccgggacggaaacgggtaacgggtaaccggacgggtacgtaacggttaacgtttaacgttaacccgttagtaaacctaaacggtaacaaaccgaagtaaacgtaagttacggttagttacgttagtacgttacgtacggtacggttcggggaaggaacgggtaacgacggtacgtacggtaccggtacgtacggtaacccg

SEQ ID NO: 302763 - DNA, 614 bp, Homo sapiens
  misc_feature: GZ8MTXP02F4IT2.52.78.H01.1.454.CMB.2.raw
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttcctgttgctattttagaaggtgtccagtgtgaggcgcagctggtggagtcgtgggggagcgttggtccagccgtgggggtccctgacactctctgtntagctntggattcacttanagttatggatgactggtccncaggctcgagggaggctggagtgggcgcagcgtagaaagcagtgacgtgggagtagaaggagacgtagtcggaccgtacttcgtggtacggaaacggggtccctaatttcccgaaccctaccgttacccgaaaggtacaaaccaaacgtanaaccgaaaagaaccctagaattacggtaactacctaaccaaaggtnaacggacaacggcctagacacgtacgaagaccgtacggccgtagttactacgtagtacgtacgtagttacggtttcgttaaggtacgttggtttacggtcgtttacgccgtaactccgg

SEQ ID NO: 302764 - DNA, 676 bp, Homo sapiens
  misc_feature: GZ8MTXP02IKAID.52.78.H01.1.454.CMB.2.raw
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggatatgcactacgaccaaagcaaattagttaggttagttaggtacagcgagacgccaggaccacggtacccccttagttggagtatatagtaacgacagtagaggacgtccccgtacgacggtactcccgtagagtcgtacttccgtcgtcgtcctcctaccgtcgaacggacaacgtacgttactacgttagctacagtaccgtagtacggtacggtaccgggcgaaacgggacgggtaacggacggtcgtaacgtaacgttaacgttaccgttacgtaacgtaacttaacgaaacgtagaaaccctacgttaagtttacgttactttacgttagttaccgttaacgtaaccggtcgaacccggaacgtaaacggtacccgaccgttaccggtacggtccaaccgaacccgtaacgaccccctaacccgtacgttcctaccgtacttaccccg

SEQ ID NO: 302765 - DNA, 673 bp, Homo sapiens
  misc_feature: GZ8MTXP02I7D0Q.52.78.H01.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagcttgggttttccttgttgcttattttagaaggtgtccagtgtgaggcgcagctgggtggagtcgtgggggagcttggtccagccgtgggggtccctgacactctcctgtgtagcctntggattcaacctttacngttatgatgtacgttcggtccnccgaggcctccggagggacggctggngtgggngacccngcgtagaagcagtgagtgggaggtgacggtaaagcttagcggcgtactcgtaggagaacggggcctaacgttccgaccaccttacgagaacgaacaacgtactaacgaaacgtacctagtaaattcgtaaatccttaacaaaagtcgacgagaaccgtaccgtacgaccgttaacgtacccgggaaggtaaccccgtcgggtaaccccggtttacgtatttaaaccccgtggggttaccgtacgggtttagttaaccggggtttttgttaacggggttacgtttacgggtttggttaacccggtttcgaacgtttacccccggtacg

SEQ ID NO: 302766 - DNA, 727 bp, Homo sapiens
  misc_feature: GZ8MTXP02GUKQW.52.78.H01.1.454.CMB.2.raw
  modified_base (221)..(221): a, c, t, g, unknown or other
  misc_feature (221)..(221): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatggttattggtaccagcagacggccaggccacggtcccccttagttggtgatatataagaccagtgagacggcctcgaggtactccgtagacgcgtattcctcgtcggtcctcctccgtacgacgggaccaactcgtacctacgttgactactacgtcgaggtcgggtacggtacccggggagaacgggacgggaccggtaggacccttaggtaactttacgttactacggttaacaaacttaacgaaaccgaaaggtaaccgtaacgggtttaaacggttacggtttaaacgtttaacggttcgggttaggtaccggttacgggggtttaccggggacgggggtaaacggggaaacccgtaaacggtccgtaaccgggtaaccccgttaccgggtaacggttacccgaaaccggaaccccggaaacggtaccccggttaccccggtaccccccggtttccggtacccttaacccgtttcccccgg

SEQ ID NO: 302767 - DNA, 635 bp, Homo sapiens
  misc_feature: GZ8MTXP02HDQVJ.52.78.H01.1.454.CMB.2.raw
  modified_base (250)..(250): a, c, t, g, unknown or other
  misc_feature (250)..(250): n is a, c, g, or t
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctctcactctctgcacaggctctggggcctcctatgaactgacacagccaccctcggtgtcagtcgtcctcgaggacaggaccggccaggactcacctgctcgtggagatgcactgacaaagctaatntgttattgaccagcagacgcaggccacgtccccttatcggtgatatagtaaggcatgagcggccngaggtactcccgtagacgtcgtatccgtcgtcgtctcctcgtcgagggtaccacgtacgtcgtaacgttntacactactacgaggtacgggtacggtcccggggagaaacgggagggaaaccgggtacgtacgtaacgtacttacgttaacgtacgtaaacaataaccgaacgtaacgtaagtacgtagttacgttaacgtgtacggtcgtacggtacggtacgggacggggtacggaaccgtacggtaccggtaccgtaccggtacgtacggtccgaccggacccgtacggtcccgtcccggtaccccgtccgtacccg

SEQ ID NO: 302768 - DNA, 577 bp, Homo sapiens
  misc_feature: GZ8MTXP02HS4AH.52.78.H01.1.454.CMB.2.raw
  modified_base (306)..(306): a, c, t, g, unknown or other
  misc_feature (306)..(306): n is a, c, g, or t
  modified_base (497)..(497): a, c, t, g, unknown or other
  misc_feature (497)..(497): n is a, c, g, or t
  modified_base (550)..(550): a, c, t, g, unknown or other
  misc_feature (550)..(550): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctatttagaaggtgtccagtgtgaggcgcagctggtggagtcgtgggggaggcttggtccagcctggggggtcccctgacactctcctgtgtagcctctggattcacctttaacagttatggatgacttgggtccncaggcctccgaggggaaggggctgggaggtggggtcggaccaggcgtgaagcatgagtggaggtgaggaagactagtgcggtaactcgtggtagaacggggccctattccgaccctaccttcccaagacgacaaaacgataccaagaactacaaatgtaatccgtcaaaagttcgaagctagccctagacntacccgagacacgggaccttgtattacctgtagcgtagtacgtgtttaagggngttgttggtccgtttgacaccccgtag

SEQ ID NO: 302769 - DNA, 597 bp, Homo sapiens
  misc_feature: GZ8MTXP02FIZDC.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccacggcccccttattcggtagatatagtaaaggaccatgagacggcctaccgagggactccgtgagcgattctcgtggctcctcctcgagggacaacagtcacgttgatcagtcgagtggaggtacccgggcaaggaggacggacggcgtagtaacgttattaaccgtagtactaaagtacaaacgaagaactaagttaacggtagggttaactttatacgggttacgtaccgtaacgggttccgggacgggtaaacggggacccgtaaaacggtcgtaccggtaaccggtcccgttaacggtacccg

SEQ ID NO: 302770 - DNA, 689 bp, Homo sapiens
  misc_feature: GZ8MTXP02I6W1T.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcgaggacaggacggccaggatcacctgctcgtggagatgcactgaccaaagcaatagtgttatcggtaccagcagacgccaggccacggccccttagtggctagtatagtaacggccaatagagacggcctacggaggctccgtggacgtgtacttccgtacgtcgaccttcctccgtacgacgggaccaaacgtcggtactacgttgaactcgaactacgaggtacggacggtacccgggacgaacgggaggggaaccgacggcgtaacggaccttaagtttaccgtaggttaaacaaacgttacaaacgtaacggtaacgaaacggttaggttaaggtacgtttaagtgggttaacgtcgtaacggtttaccgggggacggtaaacggggacccgtaaaaggtcccggtaaccggtaaaccggttccgttaacgggtccgaaccggtacccggaaaacggtcccggttaccgtacccccggttaacgtaccccgg

SEQ ID NO: 302771 - DNA, 611 bp, Homo sapiens
  misc_feature: GZ8MTXP02H8KEQ.52.78.H01.1.454.CMB.2.raw
  modified_base (466)..(466): a, c, t, g, unknown or other
  misc_feature (466)..(466): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctggtgtcagtgtcctcaggacagacggccaggatcacctgctcgtggagatgcactgaccaaagcaaatattggttattaggtaccaacagacggccaggccacggcccccttagtggtgatatataagaccatggagacggcctacgagggctcctggagctagttctccgtcggcctccctccgtacgtacgggaactacgacgtctaccgttagacgttcataccgaggtggacggtccgggacgagagggacgcggtcagtactagtactagtacaaataccaanacgacgagtagttaggttacttaagtgtgtacgtacggttaccgggacggaacggtaaccgacggtacgtcgtaccccgtacgtacgtaccgaacccgccggtaaaccggtcccgtacccgtcccccgttacggtacccttcccg

SEQ ID NO: 302772 - DNA, 614 bp, Homo sapiens
  misc_feature: GZ8MTXP02G3ZOL.52.78.H01.1.454.CMB.2.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggtttccttgttgctatttagaagtgtccagtgtgaggcgcagcgtggtggagtcgtgggggaggcttggtccagccgtggggggtcctgacactctcctgtgtagcctcgtgattcacctttaacagttatggatgtacgttcgggtccnccgaggcctccgaggggaggggctggaggtgggtcggccgaggcgtgaagcatggactggggagtgaggacatagnggcgatcgtgtggaacggctagttccaactaccttcgagacgaacaactanacaaagtaacctacgaattggtaaccttcaacctaaagttaggacggtagcccttaagacctaagtaccggaacggtaccgaacgggttcccgttaaggtacttaccgtggttacgacggttacgtacgtttacggtttggaagtttcggtttggtacgttcgcctaccggtacgtcccg

SEQ ID NO: 302773 - DNA, 656 bp, Homo sapiens
  misc_feature: GZ8MTXP02HAJ5N.52.78.H01.1.454.CMB.2.raw
  modified_base (331)..(331): a, c, t, g, unknown or other
  misc_feature (331)..(331): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgcttattttagaaggtgtccagtgtgaggcgcagcgtggtggagtcggtgggggaggtcttggccagccggttggggggtccctggacacctctccgtgtgtacgcctcgtaggtacttcctaaccctttaagtagttagttggatcgtacgttcgggcccnccgacggtcctaccggaggggaaggggtcgtagggaggtggggtcgcccgaggtcgtaggaaacgtcaagttggagtcggggaggtaggaaggtaagtactagtcggggacgtacgttcggtggtaagggacggggtactactccaacccgtactaccgagaacgaacactactacaaacgactacatacgtacttacacaaatgacgacacgtactagaaccgacgtaccggaacggaccgtaccggtaccgttagttacgttacggtgtacgaggtaaacgttgtttacgtgggttatggtttcggtactcgtacgactccgg

SEQ ID NO: 302774 - DNA, 623 bp, Homo sapiens
  misc_feature: GZ8MTXP02IPABX.52.78.H01.1.454.CMB.2.raw
  modified_base (591)..(591): a, c, t, g, unknown or other
  misc_feature (591)..(591): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctgggtggagtcgtgggggaggcttggtccaggccgtggggggtccctgacactctctgtgtacgcctctggattcacctttaacagttattggatgtacgttgggtccgccaggctaccggaggggaacggggctgggaggtggggtggccaggcgtgaaagcagtgagtgggaggtgaagggaagtaactagtggcggtaactcgtgtagggaacgggccgtattacccaccgtacttacccaagacgaacaaacatacaaagaacctacaaattagtaacttaccaaccgtaaaatgaaggaccaaggtccctagaacacgtaccggacggacgaccgggtctagttattacgtgtacgtcgtacgttagtttgtttaagggtntttcggtttggttcgtttcgactaccgtacgg

SEQ ID NO: 302775 - DNA, 764 bp, Homo sapiens
  misc_feature: GZ8MTXP02IQSQB.52.78.H01.1.454.CMB.2.raw
  modified_base (303)..(303): a, c, t, g, unknown or other
  misc_feature (303)..(303): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagttgtcctcaggacaggacggccaggatcacctgctcgtggagatgcactgaccaaagctaattagttggttattcggtaaccagacaggacgccgacggccacggcccccttagttcggtntatataataacggaccaagtggacgtacggccctacgacggggtactcccgtaggacgcgtacttcgtctcggtcctcctcctcgaacgggaaccaacgtcggttacctaacggtttacgaacctaccgtaacgttaccggtaaagggttcgggggtaacgggttccccgggggacgaaacgggaaacgggggtaaccgggacggtacccggttaaggtaaccttaaagttaaccgttcggtaaactaaacttaccgaaaacgacggtaaccgttaagggttaacggttaacggtttaaactttaggtacggtacggtacggttaaggggttccggggaacgggtaacgggtaacccggaaaggttccgtaacggacccggttaccggtaccggtacctacgggaacccgaccggtaccgttaccccggtccccgttaccgtacccgtaccgtttaccccg

SEQ ID NO: 302776 - DNA, 680 bp, Homo sapiens
  misc_feature: GZ8MTXP02I8WHL.52.78.H01.1.454.CMB.2.raw
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (478)..(478): a, c, t, g, unknown or other
  misc_feature (478)..(478): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggagcgttggtccaggccgtgggggtccctgacactctcctgtgtagcctctggattctaccttaacagttatggatgacgttgggtccnccgagctccgagggaggctggaggtggcggcagcgtagaagcatgacgtgggaggtgaaggaanactagtgggacgtactcgtaggtacggaacgggcccgtaagttacccacccttaccgttacccgaaagggaacaaaccaaactactaaccgaaaaggtaaccctanaaaagtttgtaaaccttcctaaacccgtaaaagttcggaagaccaacggcccttaggaaccctaaggtccccgggaaaggaccgtacccgggggttacccttgtttaaacgtttaccgtggttaccgacggttaaacgttaggtttttccgttaaggggttactttacgggtttacgttcggttaccacccgttaacgtcgg

SEQ ID NO: 302777 - DNA, 588 bp, Homo sapiens
  misc_feature: GZ8MTXP02JH8N0.52.78.H01.1.454.CMB.2.raw
  modified_base (284)..(284): a, c, t, g, unknown or other
  misc_feature (284)..(284): n is a, c, g, or t
  modified_base (395)..(395): a, c, t, g, unknown or other
  misc_feature (395)..(395): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgccaaagcaatatggttatgtacagcagagcagccaggccccttatgtgatanataaggacatgagtagcctgagggactccctgacgcgtattccctcgtcggcctcctcctacgacgggacaaacgagtcctaacgtgtaatcattcagtgaacgtccgganagaggacgaggcgagactatacgtagtactaaagcaaacgagaacagtagtaggtattagtgtgactaacggttcggacggaaacgggaaccgaaacggtaccgtttaccggaacccgttaccgtaacggttaaccgaaccggtaaccccgaaacggtcccggttacccgaccccccgttcgggttaaccccg

SEQ ID NO: 302778 - DNA, 749 bp, Homo sapiens
  misc_feature: GZ8MTXP02HZE5C.52.78.H01.1.454.CMB.2.raw
  modified_base (364)..(364): a, c, t, g, unknown or other
  misc_feature (364)..(364): n is a, c, g, or t
tcagcgcagtacgacacgaccggtgctcgatttagtgtgagtagtttgggtttgggggctgtgggtccaggaggcagaactctgggtgtctcaccatggcctggatccctctacttctcccccctcctcactctctgcacaggctctggggcctcctatgaactgacacagccaccctcggtgtcagtgtcctcaggacaggacggccaggactcacctgcttcgtggagatgcacgtagacccaaagcaaatattaggtttattggtaccagacaggaggccacggaccgacggtcccccttagttggtgataatacgtaaggacataggagacggccctacgagggctcccgtgacgacgtnttccctcgtcgtctcctctacgacgggaccaacgtacgtaccgtacgtttagacttactaacgtcgtacgggtacggacgggtaccccggggagaaaggggaacgggaaccggagggtacctaggtaaactttaaccgttacgttaggtaacctaacgttaaaccaaacgtaacgggaaccaagggttaaggttagggttacctttaaaggttcgtaggtacgttacgggttaccgggggaacgggtaaaccgggggtaaaccacgggggttacccgtacgggttaaaaccccggttcccggtaacgggggtttaacccaccggtaaaccccgggaaaccggttcccggaacccccgtacccccccggttttacggggtaccccc

SEQ ID NO: 302779 - DNA, 728 bp, Homo sapiens
  misc_feature: GZ8MTXP02F1RZ6.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacacagccaccctcggtgtcagtcgtcctcaggacagacggccaggactcacctgctcgtggagatgcacgtcgaccaaagcaattagttaggttattacggtaccaggacaggaacggccgggaccgacggtcccctggtcggttggtagagtagtaaagtaaacgacacgtagacggacggtccctacggacgggtacttcccgtaggacgtacgtacttcccgtcgtcggtaccgtacgtaggtaccggaaggggtaccgaacgggtaccaacgttacgttccgggactacgttacgagggttagggaccgtaccgaagggacgaacggggaaggacggacggtacgtacggtaacttagtttagttaacggtactaaacgttaacgaaaaccaacggtaaacccgtaacccttaaggtttacgggtttaaactttacggttacgttaaccggttaacgtaacttcggaaacccgtaaaccgtaacggttacccgacgttccggtacggaccgtaaccgaaccgaaccgaacccctaccgtcgtaacgtcctactttccccg

SEQ ID NO: 302780 - DNA, 666 bp, Homo sapiens
  misc_feature: GZ8MTXP02HX13V.52.78.H01.1.454.CMB.2.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtcgtcctcaggacagacggccaggatcacctgctcgngganatgcactcgaccaaagctaatataggttatggtaccagcaaggacgccgacgcccacggtccccttagtggtanaatataagtaacgaaccagtagacggtacggccctagaagggtactccgtggaacgcgtattcccgtcgtcggtcctcccgtactaccgacgggaccaaacgtcgtaccgtacgtttanacttacacgtcgtaggtacggacggtaccggngaacgggagacggtacgtcgtagacttagtacgttacgtaactaaagtacgaaacagtaacaaggttacgtaggttattaggtgtacggtagttaacgggttcggaacggggtaccggtaaccgaaacggtccgtaaccggtaccggtaccgttacgaacccgtaacggaccccggtaacggtccccgttcccggtccccgtacggtttacccg

SEQ ID NO: 302781 - DNA, 739 bp, Homo sapiens
  misc_feature: GZ8MTXP02GQIDI.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttctcccctcctcactctctgcacaggctcgtcggggcctcctatgaactgacacacgcccacccgtcggtgtcagtcgtcctcgaggacaggacggaccgaggactcacctgctcgtggagatgctacgtacgaaccaaagactaatacgttaggttagttacggtaccagcgaaggacggcccacggaccgtaccggtccccctttaggtacggtagtataagtaacgtaacggaccagtagacggaccggtccaccggacggtactaccgtagaacggcttacttcgtctcggtaccctccgtccgacgacgggaacaacgtacgtacgtacgttagtactaccgttagtacgtaaggggtaccgggtacgggacccggggaacggtaaaggggaaccgggtacggtaacggggttactaaacgtaaccgtttaacgtaaccgttacgtaaacgtaactaaacccgaaagtaaacgtaacgtaaggtttacgggttacggtttaattaggtcgttacggtaacgggttacggacgggggtaacggaaccggggaacctaaacggtccggttaccggtacccggtttaccggaacggtaaccccgg

SEQ ID NO: 302782 - DNA, 744 bp, Homo sapiens
  misc_feature: GZ8MTXP02HG6A3.52.78.H01.1.454.CMB.2.raw
tcagcgcagtacgacacgaccggtgctcgatttagtgtgagtagtttgggtttggggctggggagcctagctgtgctgtgggtccaggaggcagaactctgggtgtctcaccatggcctggatccctctacttcctccccctcctcactctctgcacaggctcgtgggcctcctatgaactgacacacgcccaccctcggtgtcagtgtcctcgaggacgagaccggccaggactcacctgctcgtggagatgcactcgaccaaagacaattagttaggttatacggtaccagacgagacggaccgacgccgaccggtcccccttagttcggtataatagtaacgtaacgacagtcgaacggacggtacctaccggagggtacctcccgaggacgtacggtacttccgtcgtcggtacccttcccgtacctacgggaacgggtaaccaaaccgtagtacccgtacgtagtactacgtacgtaccggtaggtacgggtaccggaccggggacgaaagggacgggaacgacgggtacgagttaacgtactttacaacggttaaccaagttaaccgaaaaccgtacggaaacgttaacgggttaaaggttaccggtttaatttaaacgggtcggttaaagtccggggttaaaacggggttcccggggaaacggggaaaccggtaaaccgtaaacgggccccggtttaccggtaaacccgggtttacccggtaacggttaacccccgg

SEQ ID NO: 302783 - DNA, 767 bp, Homo sapiens
  misc_feature: GZ8MTXP02HOF66.52.78.H01.1.454.CMB.2.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcactgctctggagatgcactgaccaaagctaatatggttatcgtacagcagagcagcacgccctatgnatatagtaagacatgagagcctacgaggactccgngagcgtattctcgtccggctcctccgtacgtacgggaaccaacgtcgttaccgtaacgttacgacttcaagttaccgtaaggggtacgggtaaccgggttacccggggaacgtaacggggaaccggggtaaaccgggtacgggtaccggttaacgtaaacgttttaacgttaaaccgttacggttaaacctaaacgttaaccgaaaaccgttaaacgggaaaccttaaaacgggggtttaaggtttaacgggtttaaccgtttaaaggttcgggttaaccggtaggttaacgggggtttaccgggggtaaacgggggtaaccgggaaaacccgtaaaacgggtccggttaaaccggggtaaccccgtttaaccggggtacggttaacccgaacggaaccccggtaacggtaacccggtcccggtacccccggtcggttaccctaaccgtttccccg

SEQ ID NO: 302784 - DNA, 618 bp, Homo sapiens
  misc_feature: GZ8MTXP02FP279.52.78.H01.1.454.CMB.2.raw
  modified_base (468)..(468): a, c, t, g, unknown or other
  misc_feature (468)..(468): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtcgtgggggaggcttggtccagccgtggggggtccctgacactctcctgtgtagctctggattcacctttaacagtttatggatgtacgttgggtccgccaggctccgaggggaagggctggaggtggggtcgccagcgtagaagcatgagtgggaggtagaaggaagactagtggcgtactcgtaggtaggaaacggggccgtagttacccaccctacttacccgaaagacgaaacaaacatacaaaagacctaanaattagtactacctaacaatcgacgacacgtcctagacctaacgaccggaacggacccgtacggtaccgttagttaacttacgtggtacggacgtagttacggtttcggttaagggtatttcggttacggttcgttacgacctacgtacg

SEQ ID NO: 302785 - DNA, 678 bp, Homo sapiens
  misc_feature: GZ8MTXP02FT60S.52.78.H01.1.454.CMB.2.raw
  modified_base (167)..(167): a, c, t, g, unknown or other
  misc_feature (167)..(167): n is a, c, g, or t
  modified_base (226)..(226): a, c, t, g, unknown or other
  misc_feature (226)..(226): n is a, c, g, or t
  modified_base (381)..(381): a, c, t, g, unknown or other
  misc_feature (381)..(381): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctgggcctcctatgaactgacanagccaccctcggtgtcagtcgtcctcaggacagacggccaggatcacctgctcgtgganatgcactgaccaaagcaatagtgttattaggtaccagacagacgcgaggccacggtcccccttatcggtagtatagtaagtaacggacatagagacgcctacgagactccgagagacgtactcctcgtcgactcctactacgaacgggacaaacngtaccgtaccgttgaactactacttacgaggtaggaccggtacccggacgaaggaacggacggagtacgtcgtaaactaacggttacttacgacctaaatacaaaccgtagtaaacgaggttaagtacgttaacgttaagtagttacccgtaggtaaaacgggtttcgggaaaccggggtacgggaaacgttaaacggcgttaacccgggtttaaaccggcccgttaaggtaacccgtaacgggaacccgaaaccggtaccgtcccccgtaacccccggttccggtttaaacccccg

SEQ ID NO: 302786 - DNA, 678 bp, Homo sapiens
  misc_feature: GZ8MTXP02IXOBG.52.78.H01.1.454.CMB.2.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaagtgtccagtgtgaggcgcagctggtggagtcgtgggggagcttggtccagccgtgggggtcctgacactctcctggtgtacgcctctggacttactaccctttaanagtttntggatgacttgggtccgccgaggctccgaggggaaggggctgggaggtggggtggcccaggtcgtgaacgcagtgagtgggacggtggaaggagacgtatcggcggtactcgtggtagggacggggcctacgttaccacctaccttacgaagacgaacgaaacactaacaaagtaaacctactaattacgttaacttaccctaacccgtaaaagtcgggtaacgaacccgttacgacccgttacggaaccaacggttacccgggaaacgggccgaaccggggttaccccgttaggttaactttaaccggtggtacggaccggttaggtacggtttcggtttaaggggtacttttggggttcgttcgttcgtaccgaaccgtccgg

SEQ ID NO: 302787 - DNA, 619 bp, Homo sapiens
  misc_feature: GZ8MTXP02IB3AS.52.78.H01.1.454.CMB.2.raw
  modified_base (189)..(189): a, c, t, g, unknown or other
  misc_feature (189)..(189): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctnaggacagacggccaggatcactgctctggagatgcactgaccaaagcaatattaggttatggtaaccagacgaggaggaccaggaccgaccggtccccttagtggtagtataataagtaacggaccagtagaacggacggtacccgtagaggtactccgtgacgcgtattcgtcgtaccggccttcccgtctacgacggaactaacgcgtactaacggtacattacactagtagggaggtacggtacggaccgtaagggacgggaacgacggtaccgtagtaaccttagtacctagtaccaaatacaacgtaagacgtagtagtagtaactgtagcgacgtaggtcggacgacggacaacgctacggaccgtacgacggacaccggtccgaacggtccgtacccgtcccgtaaccggtctaccgttcccg

SEQ ID NO: 302788 - DNA, 575 bp, Homo sapiens
  misc_feature: GZ8MTXP02HUT4F.52.78.H01.1.454.CMB.2.raw
  modified_base (184)..(184): a, c, t, g, unknown or other
  misc_feature (184)..(184): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (553)..(553): a, c, t, g, unknown or other
  misc_feature (553)..(553): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctatttagaaggtntccagtgtgaggcgcagctgggtggagtcgtgggggaggcttggtccaggccgtggggggtccctgactactctcctgtgtagccctgtggacttctacctttaacagtttatggatgacgttgggtccgcaggctaccggaggggaacggggctagggaggtggggtcgccgaggcgtagaagcagtgagtgggaggtagaacggtagactagtggaccgtatcgtgtagggacgggcctattaccacctactacgaagacgaacaactatacaaanacctanaattgtactacgtacaaagtcagcctagacctagacacgtacgagcgacgtctagtatactggtgacgtagtagtttgtaaggtntccggttgtccgtgacctcgcg

SEQ ID NO: 302789 - DNA, 674 bp, Homo sapiens
  misc_feature: GZ8MTXP02JH5VX.52.78.H01.1.454.CMB.2.raw
tcagcgcagtacgacacgaccggtgctcgatttagtgtgagtagttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttatcggtagatatataaggaccatggagaggcccctagaggggtactccccgtaggaacgcgtacttcccgtacgtcggtccttcccgtcctacgaacggggtacaaacgtaggtacctaccgttgacttaccagttaccagggttcggacgggtccggggactagggaacggtaccggaggtacctagggaccttaagtttactgtaactaaagtaccaaacgtaagtaacagttaagtggttaaccttaagttggttacgagtaaccgggtttcgggacggggtaaacgggacccgtaaaggtaccgccggtaacccgttcccgtaaaggtccgaacggaccccggttaaaacgggcgtttcccccggacccccgtttagggttccccc

SEQ ID NO: 302790 - DNA, 916 bp, Homo sapiens
  misc_feature: GZ8MTXP02ISC77.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttgggctgagtcgttgggttttccttgttgcttattttagaaggtgtccagtgtgaggcgcagctgggtggaggtcggtgggggacgtcgttcggtccgacggtcccgggttcggggggttcccctaggaccctacgttcccgtccgttggtacgtacgccttgttacggtactttcctaacctttaagtagtttagtggattcgtaccgtttcgggtccccaccggtaggtcctaccgggaaaggggtacggggtcgtaggggtaggttcggggtaccggacccgaacgggtcgttaggaaacgtcgtaaggttaggtaacggttagggggaagggtttaaggaaaaggggtaaaagtaacccggttagtccgggggtaccgggttacgtttacggtacgggttaaccggggaaaccggggttaccccgttaactttaacccccgaaacccgttaacccgttaccgaaaacggaccaaaacccgtaaaacttaaccgtaaacgaaaccgttaaacctacgttaaacgtttacggtaaacctttaccctaaaaccgtaaagtacccgggtaacgaacccgaacgtttacccggaagttaaacccgaccgggtaccggtaaaaccggggtaacccgtacccgggttaacgtttacgtttaacggtttacggacgggttacggtacggtttaaaccggttttaggttttcggtttaaggggtccttttaaggggtttttaccgcggtttacccgaccccgttaaacggttccccgg

SEQ ID NO: 302791 - DNA, 603 bp, Homo sapiens
  misc_feature: GZ8MTXP02H52BF.52.78.H01.1.454.CMB.2.raw
  modified_base (324)..(324): a, c, t, g, unknown or other
  misc_feature (324)..(324): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (602)..(602): a, c, t, g, unknown or other
  misc_feature (602)..(602): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgtggtttctgtgctatttagaaggtgtcagtgtgaggcgcagcgttggtgggagttcgtggggggaggtcgttgggtccaggtccgttcgggggggtcccctggacacgttctccgttgtgtacgcccttgtggacttctacttaactagttatggatgacgtttcggcnccgaggcctcgagggaggctggagtgggngccagcgtagaaacgcataggngtagggaggtaggacggaagatagtgccggtaatcgtaggtagaacggggtacctatacccactaccttccaaaggaccaacaaactanacgaaanaactanaattctaactacaaactaagacgactacgacacacgtactacgaccgacgaccgacgtcgtagttatactgtacgtacgtagtttgttgtaagtacgttcggttacgttcgaccgtacgtaccgng

SEQ ID NO: 302792 - DNA, 677 bp, Homo sapiens
  misc_feature: GZ8MTXP02GG5ZG.52.78.H01.1.454.CMB.2.raw
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctatttagaaggtgtccagtgtgaggcgcagctgggtggaggtcgtgggggagtcgttggtccaggccggtcgggggtccctgacctactctcctgtgtacgcctcgtggtacttacctaacctttaacgagttagttggatcggtacgttcgggtcccgccgaggtcctaccgggaaggggaacggggtcgtggggaggttggggtcggcccgaggtcggtagaacgctagtggacgtaggggaggtaggaagggaacgtacgttagtcggacgtacgtcggtagtacgggaacgggtcctacgttcccaaccttacctacgaagtaacgaaaccctaatacctaagaaacgtactacgtaatcgttaactacgtaacaagtcgacacgtacgacctagactacgtacccggaaggtacccgtaccggtcgttaatttaacgtccgtaggcgtaacgtacgttaggtttcggttaaggtacttggttacgcgtacacgtacgtccg

SEQ ID NO: 302793 - DNA, 533 bp, Homo sapiens
  misc_feature: GZ8MTXP02FVLKO.52.78.H01.1.454.CMB.2.raw
  modified_base (226)..(226): a, c, t, g, unknown or other
  misc_feature (226)..(226): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
tcagcgcagtacgacacgaccggtgctcgatttagtgtgagtagtttgggtttgggggctgtgggtccaggaggcagaactctgggtgtctcaccatggcctggatccctctacttcctccccctcctcactctctgcacaggctctggggcctcctatgaactgacacagccaccctcggtgtcagtgtcctcaggacagacggccaggatcacctgctctgganatgcactgaccaaagcaatagtggttattggtaccagcagagccaggccagcccctatgtgatatataaggacatgagagccctcgaggactccctagagcgattcctctcggcctcctctacgacgggacaaacgcgtactacgttgatacatcgagtggagtccggnagaggcgaagcgtagatagttatgtacaaatcaaacagacaagtagtggttaactagtgngacgtaggtcggacgggaaggtacaaaggcgtcgaccgtcgtacgcacggccgaacggctccgccccgtcggttaccc

SEQ ID NO: 302794 - DNA, 732 bp, Homo sapiens
  misc_feature: GZ8MTXP02GLFAE.52.78.H01.1.454.CMB.2.raw
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttattggtaccagcaggaggccaggcccaggtcccccttagtggtcgattataagtaaggaccagtacgagacggtccctacgaggggactccctggacgacgtatttcctacgtcggtccttacccgtctacgaacgggaacccaaacgtacggttaccgtaaccggttacgtaactacctaacgttacgacgggttacgggtaaccgggttcccggggaacgaaacgggtaacgggaaaccgggaacggtaccgttaacgggtaactttaacgttaacgttgtaaccgtaaaagttacccaaaagaccgtaaacttaaacgggtttaacggttaaggtttaaccgttttaaagtcggttacggtaaaccggttaacggggtttacggggtaaccgggggaaacggggaaacccgaaaacggttcccggtttaaaccccgggg

SEQ ID NO: 302795 - DNA, 653 bp, Homo sapiens
  misc_feature: GZ8MTXP02FMSJJ.52.78.H01.1.454.CMB.2.raw
  modified_base (302)..(302): a, c, t, g, unknown or other
  misc_feature (302)..(302): n is a, c, g, or t
  modified_base (446)..(446): a, c, t, g, unknown or other
  misc_feature (446)..(446): n is a, c, g, or t
  modified_base (544)..(544): a, c, t, g, unknown or other
  misc_feature (544)..(544): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccacctcggtgtcagtgtcctcaggacagacggccaggatcaccgtgctcgtggagagtagccactgaccaaagctaaatattggtattagtaccagacagaggccacggccgacggtccccttaagtggtnaatataagtaacggacatgagcggtccctacgagggactccctggacgtacgtacttccctacgtggtcctccttaccgacgacggggaccaacgacgtaccgtacgttgaactctatacgaggttcgggaacgtcccgggganaagggagggaacggcggtacgtacgtaaattaagttacggtacttaactaactaacaaacgaacggaagtagtaaggttacggttattagttggaagnggtaaggttccggagggggtacgaacccggtaaagtccgtcggtaaccgtaccggtaacgtcggaaccgtaccggtacggccctacccgggcccccgtttggtaccccg

SEQ ID NO: 302796 - DNA, 698 bp, Homo sapiens
  misc_feature: GZ8MTXP02G9YKF.52.78.H01.1.454.CMB.2.raw
  modified_base (187)..(187): a, c, t, g, unknown or other
  misc_feature (187)..(187): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtntccagtgtgaggcgcagctggtggagtcgtgggggagtcgttggtccaggccgttgggggtccctgacnctctctgtgtacgcctctgacttctaaccttaatagttatgatgacgttggccncaggctccggagggaggctggaggtgggcggccagcgtagaagcagtgagtggacggtagaaggaagactagtcggcgtacgtcgtagtagggaacggcgtacttacccacctaaccttaccgaaggacaaaccaaactactaacgaaaaacgtaaccttataaatttacggtaaaccttcctaaaacccgttaaaagcggaacgaccgtaaccggtacccttaacggtaaaccacggtaccggaaacgggtaaccgaacccgggggttcctttaaaagggttaaactttaccgggtggtaccggtacggttaaagggtttccgtttttaacggttgggggtaactttttgggtttacgttcggttaccgaaccggttacaacccggg

SEQ ID NO: 302797 - DNA, 550 bp, Homo sapiens
  misc_feature: GZ8MTXP02F1G3O.52.78.H01.1.454.CMB.2.raw
  modified_base (342)..(342): a, c, t, g, unknown or other
  misc_feature (342)..(342): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagccgtggggggtccctgacactctcctgtgtagcctctggattcacctttaacagttattggatgacttgggtaccgcaggctccgagggaaggggctggagtgggtgccngcgtgaagcagtgatgggagtgaggaagactagtgcggactcgtgtgaagggccgattacacctaacctccgaagagaacaanactacaaaaggacctanaagtataactctaccaaaagtgaaacncacncagacacncgagacacggctagtattcgngtacgacgtagtagttggttaaggtcttggttcgtgtacgactacgcg

SEQ ID NO: 302798 - DNA, 756 bp, Homo sapiens
  misc_feature: GZ8MTXP02IHU1F.52.78.H01.1.454.CMB.2.raw
  modified_base (539)..(539): a, c, t, g, unknown or other
  misc_feature (539)..(539): n is a, c, g, or t
  modified_base (587)..(587): a, c, t, g, unknown or other
  misc_feature (587)..(587): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagtcttgggttttccttgttgcttattttagaaggtgtccagtgtgaggcgcagcgtgggtggagtcggtgggggagtcgttggtccaggtccggtcggggggtccctggacctactcctctggtgtacgccttcgtggtacttcctaacctttaacgtagtttagttggtatcggtacgttcggggtacccgaccgagggtccctaccggggaagggggtaaggggtccggtaggggtacggggtcgggggtcggacccgacgggtaccgtaggaaacgcgaagtaggagtaggggaggtaggaaggtaacggacctagtcgggacgtacgttccgtgtacggggacggcgtactacccgacctactacccgaagactaacaaaacnctaacgaaactactaactataacggtactaacgtaaccaagtcgaacncccgtaataccgttacgaccgacgttaccggaacggtacgggacccgttacggtaagttaaaccggttcgtaggggtacgtaccgggtaaacggttttcgggttttaagggttggggttaatttcgggggttttcgtacggttcccggtaaacctaacggttaccccgg

SEQ ID NO: 302799 - DNA, 601 bp, Homo sapiens
  misc_feature: GZ8MTXP02HNW9H.52.78.H01.1.454.CMB.2.raw
  modified_base (229)..(229): a, c, t, g, unknown or other
  misc_feature (229)..(229): n is a, c, g, or t
  modified_base (262)..(263): a, c, t, g, unknown or other
  misc_feature (262)..(263): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (556)..(556): a, c, t, g, unknown or other
  misc_feature (556)..(556): n is a, c, g, or t
tcagcgcagtacgacacgaccggtgctcgatttagtgtgagtagtttgggtttgggggctgtgggtccaggaggcagaactctgggtgtctcaccatggcctggatccctctacttcctccccctcctcactctctgcacaggctctggggcctcctatgaactgacacagccacctcggtgtcagtcgtcctcaggacagacggccaggatccacctgctcgtggganatgcactgaccaaagcaatagtgttatgtaccnncagcgcacggcacgtcccttagtgngatatagtaagacagngagcgccagaggactcgngangtactctcgngtctctcncgagacagtcactcgttagnacacgtgaggtaggtacgacgggacgaaggaccggtaggacgtacgttacgtactttacgttatacggttacaaaacgttacgaaccgaaggtaacgtaagggttaggttaaccggttagtttaagtggttcggtagttacggttacgggggacgaaacggggtacctacggtaccgttacggccgtttaacncgggtaaccgacggaccgacggtcccaccggtcccgtcgtaaccc

SEQ ID NO: 302800 - DNA, 642 bp, Homo sapiens
  misc_feature: GZ8MTXP02GH3WL.52.78.H01.1.454.CMB.2.raw
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggtcgttcggtccaggccggtcggggggtccctgacctactctccgtgtgtacgcctctggtacttcaccctttaacagttatggatgacttgggtcccgccaggcctccggaaggggaaggggctgggaggtcggggtcggcccgaaggcgtaggaaagcaagtgagtggggaggtgaagggaagactagtcggccggtatcgttagagggaacgggcctattacaccctactccgaggaanaccaacnctaanaaacgtacanaaactgtactactaccaaagtgaagcacgtaccaggaccacgtccggacgacgaaccggccgttagtaaacttccgtaggtcgtacgtaaggttcggttttacggtttaagggtaacgtttggtttacggtcggtttcggccgttaaccgacgg

SEQ ID NO: 302801 - DNA, 784 bp, Homo sapiens
  misc_feature: GZ8MTXP02HNCQS.52.78.H01.1.454.CMB.2.raw
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctcgtgggcctcctatgaactgacacagccaccctcggtgtcagtgtcctcaggacagacggccaggatccacctgctcgtggagatgcactacgacccaaagacaatagttaggtttagttcggtaccagcaggacggccgacggcccacggtcccccttagttggtagaataataagtaaacgacctaagtaggaagacggccccgtacgacgggtactcccgtgacgcgtattccctacgtcgtcctcctccgtacgaacgggaccaacgacgtaccgtacgttacgtactacgtactacgtacggtggggtaccgaccgggggaccgaaaggggacggggaacggtacgggtaccgttacgtaactttaacgtttaacgttacggtaaactaaacgttaacaaaaccgtaagggtaaaccttaagggttaaacgggtttacgtttaaacgtttacggttaggttacggtacggttaacggggtttaccgggggaaccgggggttaacggggaaaaccccgtaaggggtaccttaccgggttaaccccggttacggttaaccgggtaacccggaccggtaacccccgggtaacgggtacccgttcccccgggtaccccccggtttacggtttacccccg

SEQ ID NO: 302802 - DNA, 734 bp, Homo sapiens
  misc_feature: GZ8MTXP02HI0KW.52.78.H01.1.454.CMB.2.raw
  modified_base (730)..(730): a, c, t, g, unknown or other
  misc_feature (730)..(730): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtcgtcctgaggacagacggccaggactcacctgctctggagatgcactcgaccaaagctaaatagttcgttagttcggtaccagacaggaacggtccgacggaccgacggtacccccttagttgggttagataagtaacgtaacggacctagtgacggacgccccgtagacgggactcccgtgacgtccggtatccgttacgtccgggtccttcccgtcccgttacggacggaaccgtactacggtccgtaaacggttgtaaactccgtattaaaccggggtgggtacggggtaccgggtacccgggaggaacggggtaacgggacggtacgggttaccgttaacgggtaactttaacgttaacgtaacgttaacaaaccgttaacgaaacggtaaagtacggttaagggttacgttaaggtttacgttaggtaggtacggtacggtacgggttacgggacgggtaaccggacgtacggaccgtacggtaccggacgtacgtaccgacgcccgtacgccgtacccgtacccgtccgtacgtttaccncccg

SEQ ID NO: 302803 - DNA, 723 bp, Homo sapiens
  misc_feature: GZ8MTXP02FHADJ.52.78.H01.1.454.CMB.2.raw
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
  modified_base (600)..(600): a, c, t, g, unknown or other
  misc_feature (600)..(600): n is a, c, g, or t
tcagcgcagtacgacacgaccggtgctcgatttagtgtgagtagttttgggtttggggaggtctcggagaggagccttagccctggactccaaggcctttccacttggtgatcagcactgagcacagaggactcaccatggagttggggctgagcttgggttttccttgttgcttattttagaaggtgtccagtgtgaggcgcagctggtggagtcgtgggggaggtcttggtcccaggcccggtcggggggtcccctggaccactcctcctggttgtacgtcctctggtattcctaaccctttaacagtttattggattcgtacgttcgggtcccncgaggctaccggaggggaacggggngtggaggtggggcggaccgaggcggttagaagcagtaggagtaggggaggaggaagggaaagacgttaagcgggtaccggaatttcgtacgggttagggaaaccggggtccgtaaacctttaccccgaacccgttaacccgtttacccgaaaggtaacgaaaacccgaaaactaccgtaaaccaaaacggtaaacctaccgtaaagttacgtactaacctaaacctaaagtaggaacncgtacgcgtacgaacacgtacccggagaccgtaaccggtcgttacgttacttacgtgtcggtacgtacggttacggttttaggttcgggtattttgggtcgtttcgtacgaccgactaaccgg

SEQ ID NO: 302804 - DNA, 823 bp, Homo sapiens
  misc_feature: GZ8MTXP02HGPID.52.78.H01.1.454.CMB.2.raw
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctggagctgggtttccttgttgctattttagaaggtgtccagtgtgaggcgcgagcgtgggtggaggtcgtgggggagtcgttggtccgaggcccgtggggggtccctgaccactctcctgtgtagccctgtgtatcctaccttaacagttattggntagtcgtcgggtaccnccgtaggcctaccggaggggaggccgtgggagtcggggtacgcccgaggtcggtagaaagtcgatacggacgtagggaccggggtagaaggggtaaactacgttaggtacggaccggggttacttaccgggtagggttacgggtaaacgggggcccgttaccgtttaaccccgaacctaaacccgtttacccggaaaggttaaaccccggaaacgtaaaaccgacttaaaccgaaaaacggttaaccctaaccgtaaaaggtttcggttaaacccctttaccaaaaccccgtttaaaagtcgggaaaccgtttaccaaccgggtcccttaacgggaacccccttaaggacccccgggggttaagaaaaccccgttcggggttacccgttaacgggtttattttaaacccggggtacggtacgtacccgggttaaagtttcccgggttttagttaagggttacgtttcggggttttcgtaccgttaccggaccgtaaccgtcg

SEQ ID NO: 302805 - DNA, 591 bp, Homo sapiens
  misc_feature: GZ8MTXP02JNRRM.52.78.H01.1.454.CMB.2.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagcgcagtacgacacgaccggtgctcgatttagtgtgagtagtttgggtttgggcacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgccaaagcaatagtggttattggtaaccagacagaggccacggcccacggcccccttattcggtanattanaattaaggacatcgagaggccctgagggactcccgtgagcgtattcctcgtcggccttccctcctacgacgggacaacagtccgagttgactacatcaggtaggacggtccgggacggagtacgggacgggaggtaccgtagaaccgttagttaacgtgtactaaacgtaactaaacgacgactaggtaacgtcggtaacttagtagtgcgtaggttacggcgggtaacggacctaaggcgtaaccgg

SEQ ID NO: 302806 - DNA, 621 bp, Homo sapiens
  misc_feature: GZ8MTXP02FOB4A.52.78.H01.1.454.CMB.2.raw
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
tcagcgcagtacgacacgaccggtgctcgatttagtgtgagtagtttgggtttggggctggggagcctagctgtgctgtgggtccaggaggcagaactctgggtgtctcaccatggcctggatccctctacttcctcccctcctcactctctgcacaggctctggggcctcctatgaactgacacacgcccaccctcggtgtcagtgtcctcaggacaggacggccaggatcacctgctctggagatgcactcgaccaaagacaatatggttatggacagcagagccagccacgtccctntggtnatanataaggacagngagcggcctcgaggtcncgtgacgcgtatcgtctcggctccctccgtagacgggtaacacgtacgtccacgttgacctatactgtacgggacgggtacgtacggggcacgggaaggaccgaggtcgttacgacgtttaacgttaacgtcggttaaacacgtaacgaaagacgtaaacgtaaggttaaggtacggtttaaaccttacggttagtacggtaccggttacggtaccgggggtacggtaaccggggaaccgttaaacggcccggtacggtaaaacccggccggtttaacggtccg

SEQ ID NO: 302807 - DNA, 740 bp, Homo sapiens
  misc_feature: GZ8MTXP02I2YPK.52.78.H01.1.454.CMB.2.raw
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagcgttgggttttccttgttgcttattttagaaggtgtccagtgtggaggcgcagcgtgggtggagttcgggtggggggaggtcgtttgggtcccgacgggtcccgggttcgggggggttcccctaggacctacgttcctccgtgtgtacgcttcgtggtacttcctaaccctttaanagtttatggatcgtacgttcgggtcccacgnggctccgggaaggggtacgggcgtagggaggtggggtccgacgagtcggtagaacgngtagtgaggtagggaggtaggaacggtaagtagtagtcgggacgtacgttcggtaggacgggtacgtacttactaccctaccgtaaccgtacgaaagaacctaaacgaaactacgtaaacgtaaacgtaactacgtaacgttaacgttaactaaacctaaacgtaagtacggaaccgaccgtacgtaccgtaacgtaaccgtacggtaaccggaacggtaccggtacggttacgttacgttacgttacggtggtacggtacgttacggtttcggtttacggttaaggttacgttttcggtcgttacgtacgtaccgacgtccg

SEQ ID NO: 302808 - DNA, 666 bp, Homo sapiens
  misc_feature: GZ8MTXP02JZ08K.52.78.H01.1.454.CMB.2.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgcctcgtggagatgcactgaccaaagcaatntgttagtcgtacagcagngcgacgccgacgtcccttatcggagtatatanaggaccatggagacgccctgacgggactccgtagacgctagttctcgtcggtcctcctccgtacgagggaccaacgtcgtacctacggttacatactacgtccgagggtacgggttacgggtccgggacaacggggaacgggtacggtagggtaccgttaggtaaccttaacggtttacgttacgttaaccgaaagttaaccgaacggaacgtaaccggtaaagggtttacggttacggttaacgtttaggtacgtacgggacgttacgggttacgggacgggacggaaccgtagcgtaccgtccgtacgtacggtaccaccggcccgtaacggtcccgtcccgtaccccgttcggtacctacctttcccgg

SEQ ID NO: 302809 - DNA, 667 bp, Homo sapiens
  misc_feature: GZ8MTXP02H4M1C.52.78.H01.1.454.CMB.2.raw
  modified_base (276)..(276): a, c, t, g, unknown or other
  misc_feature (276)..(276): n is a, c, g, or t
tcagcgcagtacgacacgaccggtgctcgatttagtgtgagtagtttgggtttggggaggtctcggagaggagccttagccctggactccaaggcctttccacttggtgatcagcactgagcacagaggactcacatggagttggggctgagctgggttttccttgttgctattttagaaggtgtccagtgtgaggcgcagctggtggagtcgtggggggaggcttgggtccaggccgtggggggtcccctgacactctcctgtgtagcctctggnttccacttaacagttatggatgagttcgggtccgccaggcctccggaggggaagggcgtggaggtggggtgaccgaggcgtgaagcaagtgagtagggaggtgaaggaagtacttagcgacggtaactcgtagtaggaaggggcctacgttaccaaccacttcccgaagaacgaaccctaaaactaactaacaaacgaaacctactaaagttacgttaactacctaacaaagtacgtaacgacgacgaccgtacgtaacctaacgtaaccggaacggtaaccggaaccggtaccgtacgttaacgttacgtacggtacggtacgtacggtacggtttacggttaacgggttaggttacggtttcggttacggttacgtaccgtaccgtacg

SEQ ID NO: 302810 - DNA, 670 bp, Homo sapiens
  misc_feature: GZ8MTXP02FU9BM.52.78.H01.1.454.CMB.2.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagacggccaggactcacctgctctggagatgcactgccaaagctaatactgggttaatggtaccaagcaagaggccaggccacggccccttagttcggngatatataagacctagtgagaggccctgagggactcccnggacgtccgatctccgtcggtccctcctccgtacgacggggaaccaacgtaggtcctacggtttacgacttaccgaagtcccgtaaaggttcggggaaccggttacccgggggacaaacgggaaggggaacccggttaaggggccctaagggtaccttagttaacctggttaaacacgtaaaccacgaagaacttaagggttaagtacggtttacctaaggtcgtttaagccggttaaggttcgggcggaacgggaaccgtagtacggtcgtaaccgggttcccaaggttcccaagaacccgtagcccgttaccgacccgttccggctacttccgg

SEQ ID NO: 302811 - DNA, 582 bp, Homo sapiens
  misc_feature: GZ8MTXP02FZFP0.52.78.H01.1.454.CMB.2.raw
  modified_base (416)..(416): a, c, t, g, unknown or other
  misc_feature (416)..(416): n is a, c, g, or t
tcagcgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatgttattggtaccagcagaggccgaggccaggccccttagttcggtgatatataaaggaccagtagagacggccctcgaggacttcccgtagagcgtattcccgtcgtcgctcctctcgagggaccaacgtcgtacgtacgttgactacatctaggtcggaggtccggganaggaggacgaggcgtagacttaagttacgtgtacaagtacaaacagaactagtagtttacggatttagtgtagtcgtacggttcggacgggtaggaaccctaggctacggtaccgtcgtaacggtcgacgacccgtaacggtcccgtccgtcccccgtcgtacccg

SEQ ID NO: 302812 - DNA, 485 bp, Homo sapiens
  misc_feature: GZ8MTXP01BINNW.19.5.A05.1.454.CMB.2.raw
  modified_base (221)..(221): a, c, t, g, unknown or other
  misc_feature (221)..(221): n is a, c, g, or t
  modified_base (476)..(476): a, c, t, g, unknown or other
  misc_feature (476)..(476): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccaggacagcctctaaactgctcatttatggcatctacccggaattggggccctgtccgattcagcggcagcgtgtctgggacaagatttcactctcaccatcagcagcctgcaggctgaagatgtggcggtctattactgtacaactaatattatagaaagtccagggtacttcggccctgggactaaggtgagatcagacgaattgttgctgcaacatcngtcttcaac

SEQ ID NO: 302813 - DNA, 504 bp, Homo sapiens
  misc_feature: GZ8MTXP01DB79Z.19.5.A05.1.454.CMB.2.raw
  modified_base (357)..(357): a, c, t, g, unknown or other
  misc_feature (357)..(357): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctctgggcgagaggccaccatcaactgcaggtccagcgagagtatttgacagacccaacagtaagaactacttggcttggtatcagcaagaaaccaggacagcctacctaaactgctcatttattggcatctaccggaaattgggtccctgccgattcagcggcacgcgtgtctgggacaagatttcactctcaccntcagcagcctgcaggctgaaagatgtggcgtctagttactgtacaaactaaattattaatgaaaagtccgaagggtactttccggccctgggactaagggtggaagatcagacgaacttgttggctgcaaccatcttgtcttctaac

SEQ ID NO: 302814 - DNA, 498 bp, Homo sapiens
  misc_feature: GZ8MTXP01B6A7A.19.5.A05.1.454.CMB.2.raw
  modified_base (474)..(474): a, c, t, g, unknown or other
  misc_feature (474)..(474): n is a, c, g, or t
tcagtactctcgtgcacgaccggtgctcgatttagatagatagacaggcagggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctcctaaactgctcatttatgggcatctacccgggaaattggggtccctgtccgattcagcgccagcgtgtctgggacaagatttcactctcaccatcagcagcctgcaggctgaagatgtggcggtctattactgtacaactaattattatagaaagtccaagggtactttcggcccgtgggactaaggtggagatcagacgaacttgnggctgcaacatcttgtcttctaac

SEQ ID NO: 302815 - DNA, 510 bp, Homo sapiens
  misc_feature: GZ8MTXP01EAGVH.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactactggcttggtatcagcagaaaccaggacagcctacctaaactgctcatttatggcatctaccggaattgggccctgtccgattcagcggcacgcgtgtctgggacaagatttcactctcaccatcagcagcctgcaggctagaagatgtggcgtctattactgtacaaactaattattatagaaaacgtccgaaggggtacctttcgggccctaggggacctaaagggtgaaggatcgagacgaacttggttggctgcaacatcttagtccttcaac

SEQ ID NO: 302816 - DNA, 523 bp, Homo sapiens
  misc_feature: GZ8MTXP01BQZT6.19.5.A05.1.454.CMB.2.raw
  modified_base (220)..(220): a, c, t, g, unknown or other
  misc_feature (220)..(220): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtccagcgagagtatttgacagacccaanagtaagaactacttggcttggtatcagcagaaaccaggacagcctacctaaactgctcatttatggcatcgtaaccggaattcggggtccctgtccgattcagcgcacgcgtgtcgtgggacaagtatttcactctcaccatcagcagcctgcaggctagaagatggtggcggtctatactgtacaaactaatattatagaaacgtccgagggtactttcggcccgtagggtactaagggtggagagtacgaggaacgtaacttggttacggctaacgcaacctatccttgtccttcgtaacc

SEQ ID NO: 302817 - DNA, 659 bp, Homo sapiens
  misc_feature: GZ8MTXP01AP3N8.19.5.A05.1.454.CMB.2.raw
  modified_base (468)..(468): a, c, t, g, unknown or other
  misc_feature (468)..(468): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtccagcgagagtatttgacagacccaacagtaagaactacttggcttggtatcagcaagaaaccaggacagaccctacctaaaactgacttactattttaagttggggacctaacgttaccgttaaaccccgggggtaaagtttccggggggtccccttcggttaccccgatttccgaggtccgggacacggtccggttggtccgtaggggacctaaaggtacttttcccaactcctacaacccatccgagtcagccctgacagggctaggaaagnttgggtcgggcgttacttaacttacgtgtaacctaaataattaattaagtacggaaacgtcccgtaagggtacctttccgggacccgtaggggtaaccttaaaggggtggtaacgttagtacgaaaggtaaccgtaacgttgggttcggccgtcgacctaacccgtattccgttacgtccgttcctaaccg

SEQ ID NO: 302818 - DNA, 523 bp, Homo sapiens
  misc_feature: GZ8MTXP01DLMTK.19.5.A05.1.454.CMB.2.raw
  modified_base (507)..(507): a, c, t, g, unknown or other
  misc_feature (507)..(507): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggtatcagcaagaaaccaggacagcctacctaaactgctcatttatggcatctaccgggaattggggtccctgtccgattcagcggcacgcgtgtctgggacaagatttcactctcaccatcagcagcctgcaggctagaaagagtggtagggcggttctaattactgtacaaactaaattattaagtagaaacgtccgagggtacctttcggcccgtagggactaagggtggagatacgagacgaacgttggttgactgacaactntcttgtcttcgtaacc

SEQ ID NO: 302819 - DNA, 513 bp, Homo sapiens
  misc_feature: GZ8MTXP01BU7XT.19.5.A05.1.454.CMB.2.raw
  modified_base (222)..(222): a, c, t, g, unknown or other
  misc_feature (222)..(222): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagcctccagacacactggctgtgtctctgggcgagagggccaccatcaactgcaggtccagcgagagtattttgacagacccaanagtaagaactacttggcttggtatcagcagaaaccaggacagcctcctaaactgctcatttatggcatcgtaacccgggaattcggggtccctgtccgattcagcggcagcgtgtcgtgggacaagatttcactctcaccatcagcagcctgcaggctagaagagtggtggcggtctattactgtacaaactaattattatagaaagtccgagggtactttcggccctagggactagggtggagatcgagacgtaacgttggttcggctgcaaccgtatcttgtcttctcg

SEQ ID NO: 302820 - DNA, 541 bp, Homo sapiens
  misc_feature: GZ8MTXP01BUUEV.19.5.A05.1.454.CMB.2.raw
  modified_base (221)..(221): a, c, t, g, unknown or other
  misc_feature (221)..(221): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcaagaaaccaggacagcctacctaaactgctctatttatggcatcgtaaccccggggaattcgggggtccctgtccgattcagcggcagcgtgtcgtgggacaagtactttcactcacaccatccagcacgcctgcaggctagaaagagtggtcggcggttctaagttactgtaccaaataattaattagtagaaagtccgaagggtacctttcggacccgtagggtaacgtaagggtggaagatacgaagaaccgtaagnggttgctaagcaaccnttcttcgttcttcgtc

SEQ ID NO: 302821 - DNA, 534 bp, Homo sapiens
  misc_feature: GZ8MTXP01A92SL.19.5.A05.1.454.CMB.2.raw
  modified_base (220)..(220): a, c, t, g, unknown or other
  misc_feature (220)..(220): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (484)..(484): a, c, t, g, unknown or other
  misc_feature (484)..(484): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtccagcgagagtatttgacagacccaanagtaagaactacttggcttggtatcagacaagaaaccaggacacgaccctacctaaactgctctatttagttggctataccgtaacccggggtaaattcggggtccctggtccgattcgagcggcacgcgtgtcgtgggacaagtactttcactctcaccatcagcacgctgcgaggctagaagtntggnggtcgtactattactgtacaaactaatattagagaaacgtcgaggtactttccggccgtagggaacgttagggngagatacaggacgtaacgttgttggctggaccaacctntcttntcttctc

SEQ ID NO: 302822 - DNA, 530 bp, Homo sapiens
  misc_feature: GZ8MTXP01A3BJH.19.5.A05.1.454.CMB.2.raw
  modified_base (221)..(221): a, c, t, g, unknown or other
  misc_feature (221)..(221): n is a, c, g, or t
  modified_base (347)..(347): a, c, t, g, unknown or other
  misc_feature (347)..(347): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttgcttggtatcagcaagaaaccaggacagccctacctaaactgctacatttagtggcatcgtaacccgggtaagttcggggtccctggtccgattcagcggcagcgtagtcgngggtacaagatttcactctacacagtcagcacgcctgcaggctagaagatgtgccgttatattactgtacaataattattaagtagaaacgtccgaaggggtaacctttccgggcccgtagggtaactaagggtgaaggatcgagaacgtaacttgttgctgaccaactntnttctcttcgtc

SEQ ID NO: 302823 - DNA, 505 bp, Homo sapiens
  misc_feature: GZ8MTXP01C2AKL.19.5.A05.1.454.CMB.2.raw
  modified_base (219)..(219): a, c, t, g, unknown or other
  misc_feature (219)..(219): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtcagcgagagtatttgacagacccaanagtaagactacttggcttggatcagcaagaaaccaggacagcctacctaaactgctcatttatggcatacgtacccgggaaattcgggtccctgtccgattcgagcggcagcgtgtcgtgggacaagtatttcactctcaccatcagcagcctgcaggctagaagagtgnggacgtctattacngttacaataaatataanagaaagtccgaggtacctttcggccctggggaactaaggtggaagatcagacgaattgttgctgcaacctntcttgtcttntaac

SEQ ID NO: 302824 - DNA, 692 bp, Homo sapiens
  misc_feature: GZ8MTXP01EOP8I.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgaggacggccaccatcaactgcaggtccagcgagtagttatttgaacacgaacccaacagtaagaacttacttggcttggtatcagacaagaaaccaggacacgccctacctaaactgtctactatttagtcggactacgtaccgtaacccgggtaaagtttcggggtccccttgtcccgtattcgaggcggcacggtcgtagtcgtagggactaagtactttcactcctaccacctataccgagtaccacgtccgtcggaccgagggtccgtaaggtaaacggtaggttcggtacggggtaccgttaccttaagtttaccgtagtaaaccgtaaaacttaaagttaacgtttaacgaacggtaaaccggttcccgggtaagggttacccgtttaccgggacccgttaaggggtaaccgtaaggggttaacgaagttacgtaacggacggtaaacggtaacgttcgggttcggttaccgtcggacctaacgtacttccgttacgttccgttaacgtaacccg

SEQ ID NO: 302825 - DNA, 625 bp, Homo sapiens
  misc_feature: GZ8MTXP01DZ5UX.19.5.A05.1.454.CMB.2.raw
  modified_base (222)..(222): a, c, t, g, unknown or other
  misc_feature (222)..(222): n is a, c, g, or t
  modified_base (430)..(430): a, c, t, g, unknown or other
  misc_feature (430)..(430): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagaggccaccatcaactgcaggtccagcgagagttatttgacagacccaanagtaagaactacttggcttggtatcagacaagaaaccaggacacgaccctacctaaaactcgctactaattttagttggggacctaagtccgtaaaccccgggggtaaatttcgggggtccccttggtccgtattccgaggcgcacgcgtgtcgtgggactaagtactttcactctacaccatcagcagcctgcgaggctaggaaagngttggtcgggtacggttacttaagttactacgtaacaaacttaaattaagttaagaaggtaaacgtccgtaagggttaccctttccggtacccggtagggtaacggttaagggtaaggaagttacgtacgaaaggtacccgtaaagttgttcggacgtgaccgtaacctgttccgttcgttcccttaacgttccc

SEQ ID NO: 302826 - DNA, 516 bp, Homo sapiens
  misc_feature: GZ8MTXP01A0LUG.19.5.A05.1.454.CMB.2.raw
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (472)..(472): a, c, t, g, unknown or other
  misc_feature (472)..(472): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttatttgacagacccaacagtaagaactacttggcttggtatcagacagaaaccaggacagcctacctaaactgctctatttagtggcatccgtaacccggggaaattcgggggtaccctgtccgattccgaggcgcacgcgtgtcgtgggacaagtactttcactctcacctatcagcagcctgcaggctagaagntgnggcgtctatactgcaaataatatatagaaacgtcgagggtacttcggccctagggactaagggtgagntacagaacgaacttgttgctaagcaacntnttcgtcttcgaacc

SEQ ID NO: 302827 - DNA, 548 bp, Homo sapiens
  misc_feature: GZ8MTXP01BPMKK.19.5.A05.1.454.CMB.2.raw
  modified_base (221)..(221): a, c, t, g, unknown or other
  misc_feature (221)..(221): n is a, c, g, or t
  modified_base (363)..(363): a, c, t, g, unknown or other
  misc_feature (363)..(363): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtccagcgagagtattttgacagacccaanagtaagaactacttggcttggtatcagacaagaaaccaggaacacgcctacctaaactgccttactaatttagttgggctaagtccgtaaacccggggtaaatttcgggggtcccctgtccgattcaggcgcagcgtgtcgnggacagtactttcactctcaccatcagcacgcctgcaggctagaagtgtgtggcgttactattactgtacaactaattatagagaacgtcgtagggtacctttccggaccgtagggactaagggtgagttactcgagaccgaacgttggttcggctgaccaacgtactcttgttccttcgtaacc

SEQ ID NO: 302828 - DNA, 588 bp, Homo sapiens
  misc_feature: GZ8MTXP01BNRYG.19.5.A05.1.454.CMB.2.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (447)..(447): a, c, t, g, unknown or other
  misc_feature (447)..(447): n is a, c, g, or t
  modified_base (573)..(573): a, c, t, g, unknown or other
  misc_feature (573)..(573): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtggggcgaggtcgggccaccatcaactgcaggtccagcgagagttatttgaacagacccaanagtaanaactactgggcttggtatcagacaagaaaccaggacagccctacctaaactgactactattttatcgggactaacgttccgtaaaccccggggtaaagtttcgggggtaccccttggtacccgattccgaggtcggcaggcgttgtccgtaggggacctaagtactttccaactcctaccacctatcgagcagccctagcaggtctaggaaagtntggtcgggacgttactagttactagttacaaactaattatacgtagaaacgtccgtaagggtaccttcggccgtaggtacgtagggtcgagttatacgacggagtaacgttgcggctgaccaactntcttcgttcttctcg

SEQ ID NO: 302829 - DNA, 553 bp, Homo sapiens
  misc_feature: GZ8MTXP01ARK0Y.19.5.A05.1.454.CMB.2.raw
  modified_base (222)..(222): a, c, t, g, unknown or other
  misc_feature (222)..(222): n is a, c, g, or t
  modified_base (543)..(543): a, c, t, g, unknown or other
  misc_feature (543)..(543): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttatttgacagacccaanagtaagaactactggcttggtatcagcaagaaaccaggacacgaccctacctaaactgctacaatttagtggctataccgtaaccccgggtaattcgggggtccctgtccgattcagcggcacgcgtgtcgtgggactaagtactttcactcctacacctatcagcagccctgacgagctagaaagtgtgtggacgtctaattactagtacaaactaattattaactagaaacgtcgaagggttacctttcggccgtagggaactagggtaacgagatcgagtaacgaacttggttcggcctgaccaacctagttccgttnttcttctaac

SEQ ID NO: 302830 - DNA, 559 bp, Homo sapiens
  misc_feature: GZ8MTXP01EESMQ.19.5.A05.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (401)..(401): a, c, t, g, unknown or other
  misc_feature (401)..(401): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggtgagagggccaccatcaactgcaggtccagcgagagttatttgtacagacccaanagtaanaactacttggcttggtatcagcaagaaaccaggacagcctacctaaactgctcatttatggcatccgtaaccggaattcggggtccctgtccgattcagcgcacgcgtgtcgtgggactaagtatttcactctacaccatcagcagctgtagctagaagtagtgtggcggtnttagttactagtacaaacgtaaattatttaatagtaaaacgtccgaaggggtacctttcgggaccctggggaacttaagggngggaanagttcgaaggttaacgaacgttggaggttcttgaacctactaattcgtgttccttcttaacgtttccccg

SEQ ID NO: 302831 - DNA, 544 bp, Homo sapiens
  misc_feature: GZ8MTXP01EV2SC.19.5.A05.1.454.CMB.2.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (491)..(491): a, c, t, g, unknown or other
  misc_feature (491)..(491): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttatttgtacagacccaacagtaagactactggcttggtatcagcagaaaccaggacagcctacctaaactgctcatttagtgggctactcgtaacccgggtaaagtttcgggggtacccctggtccgattcgaggcggcacggcgtgtcgtggaccaagatttcactctcaccatcagcagcctgcaggctgaaagngtggnggcgtctattacgtgtaccaagtaatattagtagaaagtccgaagggtacctttcggcccttaggggaaccgtaagggtggganagtccgagacgtacgttaggcgactgactaacnctcgttgtccttntaacccg

SEQ ID NO: 302832 - DNA, 584 bp, Homo sapiens
  misc_feature: GZ8MTXP01EKA4P.19.5.A05.1.454.CMB.2.raw
  modified_base (569)..(569): a, c, t, g, unknown or other
  misc_feature (569)..(569): n is a, c, g, or t
tcagtactctcgtgcacgaccggtgctcgatttagatagatagacaggcaggggcagcaagatggtgttgcagacccaggtcttcatttctctgttgctctggatctctggtgccgttcggggacatcgtgctgacccagtctccagacacactggctgtgtctcgtgggcgagacggccaccatcaactgcaggtccagcgagagttatttgaacacgacccaacaagtaagaactacttggcttggtatcagacaagaaacaggacagcctactaaactgctctaatttagtggactacgtaccgtaacccggggtaaagtttcgggggtccccttgtaccgtattcgaggccggctacggcggttggtcgtggggactaagtactttcactctaccaccatcagcacgtcctgcgaagctagaaagtcgtggtcggcgttactattacgtcgtaacaaataattaattacgagtaaacgtccgagggttaccttcgggaccgtagggaacgtaagggtgagttagtacgaaaggtaccgtaagttggcggctaacgccaaccgttntcttcgttcttcgtc

SEQ ID NO: 302833 - DNA, 617 bp, Homo sapiens
  misc_feature: GZ8MTXP01EF5WT.19.5.A05.1.454.CMB.2.raw
  modified_base (230)..(230): a, c, t, g, unknown or other
  misc_feature (230)..(230): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccaccatcaactgcaggtccagcgagtagttatttgacagaccaacagtaanaactactggcttggtatcagacaagaaacaggacacgacctactaaactgctactatttagtacggactaacgtaccgtaaccgggggtaaagtttcgggggtaccccttggtaccgtattccgaggcggcacggcgtgtcgtaggacaagtacttcactctaccaccntccagtcacgctgcgagctagaagtntggtacgtcgtactattactacgtactaaataattaattagtaagaaaccgttcggaacgggttaccgttaccggtcccggtaagggtaaccgttaaagggtaaggaagttacgtacgaacggtaaaccgtaacgttggttcggttaccgttaacggacctaactactcggttcttccgtttccgtaacccg

SEQ ID NO: 302834 - DNA, 582 bp, Homo sapiens
  misc_feature: GZ8MTXP01CPX27.19.5.A05.1.454.CMB.2.raw
  modified_base (224)..(224): a, c, t, g, unknown or other
  misc_feature (224)..(224): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (562)..(562): a, c, t, g, unknown or other
  misc_feature (562)..(562): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagttattttgacagacccaanagtaagaactacttggcttggtatcagacaagaaaccaggacacgcctactaaactgactctatttagtggctactaccgtaaccgggtaagttcgggggtccctgtccgtatcgagcgnacggtcgtgtcgtaggacaagttacttcgactcncaccatcagcacncctgcgaggctagagtacgtggtcggtacgttactacgttacgtacgtaacctaaataaattagttaacgtacgaaacgtccggtaggtaccgttcggtacccgtagggtaacgtaagggtcggaattacgtacgaaggtaaacgtcgttaggttcggctcgactaacctntcgttactcgttcctaaccg

SEQ ID NO: 302835 - DNA, 677 bp, Homo sapiens
  misc_feature: GZ8MTXP01CAITH.19.5.A05.1.454.CMB.2.raw
  modified_base (426)..(426): a, c, t, g, unknown or other
  misc_feature (426)..(426): n is a, c, g, or t
tcagtactctcgtgcacgaccggtgctcgatttagatagatagacaggcaggggcagcaagatggtgttgcagacccaggtcttcatttctctgttgctctggatctctggtgccgttcggggacatcgtgctgacccagtctccagacacactggctgtgtctcgtgggcgagacgggccaccatacaactgcaggtccagcgagtagttatttagacaacgaacccaaacgtaagtaaacgtaacttacgttggtcttaggtactcagacaacgaaaccaggacacgacctactaaactcgacttactatttagtggactacgtacccgtaaccgggtaagttcgggggtccctggtaccgtagttcgacggccggcacggtcgttgtcgtaggactaagtactttcactcgtaccacatcgancgtacgcctagcaggactaggaaagtgtcggtagggcgttacttaacgtacgttacgaacctaaaattaattaacgttaagaacggtaaacgttccggtaacgggttaccgttccgggtacccggttaggggtaaaccgtaggggtaaggaacgttaacgtaacgacggtaaaccgggtaacttgggggttcgttcctaacggtaccctaaaccgttcgttccgtttcgttaaccgtttccgttaaccccg

SEQ ID NO: 302836 - DNA, 666 bp, Homo sapiens
  misc_feature: GZ8MTXP01CTFE4.19.5.A05.1.454.CMB.2.raw
  modified_base (224)..(224): a, c, t, g, unknown or other
  misc_feature (224)..(224): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagtagtatttgaacagacccaanagtaagactacttggcttggatcagcaagaaaccaggacacgacctacctaaactgactactaatttagtcggactacgttaccgtaacccggggtaaaagtttccgggggtaccccttaggtacccgtattccgaacggcggcctacggccgtggtcgtaggggaactaagtactttccactctacaaccatcancacnccgtgcgaggctaagaaagtgttggtcgggtacgttacttaacgttacttacgtaacgtaaaactaaagttaacttaagtaacggtaaacgtcccggtaagggttaacccgttttcggacccgttaggggtaaccgtaagggtaacggtaagttaacgtaccgaaggtaaaccggtaaacgttggttacggccgttaacgaccctaaccttacgtcgttactttccgttaacgttaaccccg

SEQ ID NO: 302837 - DNA, 626 bp, Homo sapiens
  misc_feature: GZ8MTXP01AXJ6B.19.5.A05.1.454.CMB.2.raw
  modified_base (221)..(221): a, c, t, g, unknown or other
  misc_feature (221)..(221): n is a, c, g, or t
  modified_base (602)..(602): a, c, t, g, unknown or other
  misc_feature (602)..(602): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagaggccaccatcaactgcaggtccagcgagagtatttgacagacccaanagtaagaactacttggcttggtatcagacaagaaaccaggacagcctacctaaactgctactatttagtggctagtccgtaacccgggtaagttcgggggtccctggtccgattcgagcggcacgcgtgtcgtgggacaagtattcactctcaccatcagcagcctgaccgagtctaggaaagtgttggtgggtaccggttactaacgtttactacggttaaacaaaacttaaatttaatttaaagtaggaaaaccgttccggtaaacggggttaacccgtttccgggtacccgtagggggtaaaccgttaagggggtaagaacgttagttacccgaaggtaacccgtaagttcgggttggaccttcggacctaaccgttnttccgttacgttcttccgtaaccg

SEQ ID NO: 302838 - DNA, 674 bp, Homo sapiens
  misc_feature: GZ8MTXP01AMAG6.19.5.A05.1.454.CMB.2.raw
  modified_base (226)..(226): a, c, t, g, unknown or other
  misc_feature (226)..(226): n is a, c, g, or t
tcagtactctcgtgcacgaccggtgctcgatttagatagatagacaggcaggggcagcaagatggtgttgcagacccaggtcttcatttctctgttgctctggatctctggtgccgttcggggacatcgtgctgacccagtctccagacacactggctgtgtctcgtggggcgagagggccaccatcaactgcaggtccagcgagagttattttgacagacccaanagtaagaactactggcttggatcagacaagaaaccaggacacgcctacctaaactgccttactatttagtggactacgtacgtaacccggggtaaagttcgggggtccctggtccgattcgagcggtcacgcgtgtcgtgggactagtactttcactctacaccatcagcacgcctgccgagggctaggaaagtgtcgggtcgggtcggttaccttaaattcgttacggtaacctaaaactaaatttaagtttaaagtaacggtaaaacggttcccggtaacgggggtttaacccgttttcccggggaccccgttaagggggtaaaccgtttaaagggggtggaaacgggttattacgaaacgggtaaacccgtaacggtttgggttcggacccgttggaccctaaacccggttcgtcccgtttacgtttccgtttccttaaccccgg

SEQ ID NO: 302839 - DNA, 599 bp, Homo sapiens
  misc_feature: GZ8MTXP01BS1RA.19.5.A05.1.454.CMB.2.raw
  modified_base (223)..(223): a, c, t, g, unknown or other
  misc_feature (223)..(223): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccaccatcaactgcaggtccagcgagagttatttgacagaccaanagtaaagaactacttggcttggtatcagacaagaaaccaggacacgcctacctaaactgactctatttagtggactacgttaccgtaacccggggtaaagtttcgggggtccccttggtaccgtattcgacggcggctacggtcggtgtcgtggggactaagtactttcactctcaccatcacgtcacgcctgacgaggctagaaacgtgttgggtcgggcggttacttattacgtacgtaaccaaattaaattaattaagtagtaaacggtccgaagggttacctttccgggaccgttagggaacgttaggggtaacgaagttatacgaggaaccgtagttggcgctgactctagttcttcgtcctttcgtaacc

SEQ ID NO: 302840 - DNA, 520 bp, Homo sapiens
  misc_feature: GZ8MTXP01CM8KO.19.5.A05.1.454.CMB.2.raw
  modified_base (387)..(387): a, c, t, g, unknown or other
  misc_feature (387)..(387): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcaagaaaccaggacagcctacctaaactgctcatttatgggcatctacccgggaattgggggtccctgtccgattcagcggcagcgtgtctgggacaagtatttcactctcaccatcagcagcctgcaggctagaagngtggtggcggttctaattactgtacaaactaattattagtagaaagtccgaagggtacctttcggccctaggggactaagggtggagagtcgagacgtaacgttggnggctgccaacntcttgtcttcgtaac

SEQ ID NO: 302841 - DNA, 584 bp, Homo sapiens
  misc_feature: GZ8MTXP01D64H8.19.5.A05.1.454.CMB.2.raw
  modified_base (222)..(222): a, c, t, g, unknown or other
  misc_feature (222)..(222): n is a, c, g, or t
  modified_base (541)..(541): a, c, t, g, unknown or other
  misc_feature (541)..(541): n is a, c, g, or t
  modified_base (572)..(572): a, c, t, g, unknown or other
  misc_feature (572)..(572): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagaggccaccatcaactgcaggtccagcgagagttatttgacagacccaaanagtaaagaactacttggcttggtatcagacaagaaaccaggacagccctacctaaactgctactaatttagtggactacgtaccgtaacccggggtaaagtttcgggggtccccttggtcccgtattcaggcggactacggcgtgtcgtgggactaagtactttccactcctaccaacctatcgagcacgtccctagaccgagggctagaaagtgtggtcggtcgttacttaattaacgtagtaacaaaataattaattaagtaagtaaacgtccgtagggtaccttcggaccgtagggaacgtaagggtaagaagttnacgaagaacgtaattggttgactgacaactntcttctcttctc

SEQ ID NO: 302842 - DNA, 494 bp, Homo sapiens
  misc_feature: GZ8MTXP01ENU27.19.5.A05.1.454.CMB.2.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctacctaaactgctcatttattggcatctaccgggtaaatggggtccctgtccgattcagcgcacgcgtgtcgtgggacaagatttcactctcaccatcagcagcctgcnggctgaagntgtggcgtctatctgtacataatatatagaacgtcaggtcttcggccctagggactaagggngagactgagacgtaacnggttgctgctaacctntcttcgtcttcgtn

SEQ ID NO: 302843 - DNA, 528 bp, Homo sapiens
  misc_feature: GZ8MTXP01DF1KI.19.5.A05.1.454.CMB.2.raw
  modified_base (223)..(223): a, c, t, g, unknown or other
  misc_feature (223)..(223): n is a, c, g, or t
  modified_base (392)..(392): a, c, t, g, unknown or other
  misc_feature (392)..(392): n is a, c, g, or t
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
tcagtactctcgtgcacgaccggtgctcgatttagatagatagacaggcaggggcagcaagatggtgttgcagacccaggtcttcatttctctgttgctctggatctctggtgcccttcggggacatcgtgctgaccccagtctccagacacactggctgtgtctctgggcgagaggccaccatcaactgcaggtccagcgagagtattttgacagacccaanagtaaagaactacttggcttggtatcagacaagaaaccaggacagcctacctaaactgctctatttagtggcatccgtaacccgggaattcggggtccctgtccgtattcagcgcacgcgtgtcgtggacagtattcactctcacatcagcagctgcaggctagaaagntggtggcgttctattactagtacaaacgtaattagttaagtagaaacgtccgagggttaccttcggcccgtagggactagggtgganagtcgaagtaacgcgttaggngctgacaacctntcttcttcttcgtaac

SEQ ID NO: 302844 - DNA, 599 bp, Homo sapiens
  misc_feature: GZ8MTXP01EJZDR.19.5.A05.1.454.CMB.2.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagtatttgacagacccaanagtaanaactacttggcttggtatcagcaagaaaccnggacagccctactaaactgctcatttagtgggctagtccgtaaccgggtaaatttgggggtcccctggtccgattcagcgcagcgtgtcgtgggacaagactttcactctacaccatcagcagcctagcaggctagaaacgngttggnggacgttctaattaccgtgtaccaaataagttaattaagtacgaaaacgtcccgtaaggggtaaccttttccgggcccgtaggggtaaccgttaaaggggtggaacgttaagtacggaaacggaacgtaaacgtttggagggttccttaaggacctaaccctaggttccttcgtttaaccctttcgtaaccg

SEQ ID NO: 302845 - DNA, 597 bp, Homo sapiens
  misc_feature: GZ8MTXP01EYPUA.19.5.A05.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (399)..(399): a, c, t, g, unknown or other
  misc_feature (399)..(399): n is a, c, g, or t
tcagtactctcgtgcacgaccggtgctcgatttagatagatagacaggcaggggcagcaagatggtgttgcagacccaggtcttcatttctctgttgctctggatctctggtgccgttcgggacatcgtgctgacccagtctccagacacactggctgtgtctcgtgggcgagacgggccaccatcaactgcaggtccagcgagagttatttgacagacccaanagtaanactacgtggcttggatcagacaagaaaccaggtacacgaccctacctaaactgctactattagtggctactccggtaaccggtaagttcgggtccctgtccgattcgaggcgcacgcgtgtcgtggacaagtattcactctcacntcancacgctgcgagctagaacgntggtcgcgtactatacgtctaactaataaagttattaagtacgtaaacgtccggtaagggttaccgtttccggggacccgttaggggtaaccgttaaggggaacgtaaggttacgtaacgaacggaaccgtaacggttggttcgggttactaacggcctaaaccggttcttccgttcgtttcccgttccggttaaccc

SEQ ID NO: 302846 - DNA, 657 bp, Homo sapiens
  misc_feature: GZ8MTXP01DVIAY.19.5.A05.1.454.CMB.2.raw
  modified_base (221)..(221): a, c, t, g, unknown or other
  misc_feature (221)..(221): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtgggcgagaggccaccatcaactgcaggtccagcgagattatttgtacagacccaanagtaagactattggcttggtatcagacaagaaaccaggacacgacctacctaaactgctactatttagttgggacacgtacgtaaaccccgggtaaagtttcgggggtaccccttggtccgtatttccgagcggcgacgcgtgtcgtgggacaagtacttcnctctaccactatcagcacnccgtagcagctaggaagtagttcggtaggtcggttactaattacgtacgttacaaacttaattaacttaagtacggaaaacgttccggtaacgggttaaccgtttccggggtaccccggttaaggggaaccgttaaaggggtaaggtaagttaacgtacgttaaacggtaacccggtaaacttgggttcgggactaacgggtaccctaaacccgttcttaccggttcgtttaacccgtttaaccgtttaaccccg

SEQ ID NO: 302847 - DNA, 621 bp, Homo sapiens
  misc_feature: GZ8MTXP01AQGV3.19.5.A05.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (380)..(380): a, c, t, g, unknown or other
  misc_feature (380)..(380): n is a, c, g, or t
  modified_base (403)..(403): a, c, t, g, unknown or other
  misc_feature (403)..(403): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagtagttatttgacagaccaanagtaanaactacttgcttggtatcagcaagaaacaggacagccctactaaactgctatatttagtggacataccgtaccgggtaagttcgggtccctgtcgattcgagcgcgacgcgtgcgtagggactaagtacttcacgtcctacacctatcgancacgctgcgaggtacaggaaagngttaggtcgggtacgttcgttaattacgtacgtaactaaactaatttaagtacgttaagtaacggtccggtaagggttaccgtttaccgggtacccggttaggggtaaaccgttaaggggtaacggtaacgttacggtaccgaaacggtaaccggtaacggttcggttcgggctaaccggactaaccggtattccgttacgttccgttgttaaccccg

SEQ ID NO: 302848 - DNA, 640 bp, Homo sapiens
  misc_feature: GZ8MTXP01BBBQL.19.5.A05.1.454.CMB.2.raw
  modified_base (236)..(236): a, c, t, g, unknown or other
  misc_feature (236)..(236): n is a, c, g, or t
  modified_base (381)..(381): a, c, t, g, unknown or other
  misc_feature (381)..(381): n is a, c, g, or t
  modified_base (582)..(582): a, c, t, g, unknown or other
  misc_feature (582)..(582): n is a, c, g, or t
  modified_base (608)..(608): a, c, t, g, unknown or other
  misc_feature (608)..(608): n is a, c, g, or t
tcagtactctcgtgcacgaccggtgctcgatttagatagatagacaggcaggggcagcaagatggtgttgcagacccaggtcttcatttctctgttgctctggatctctggtgccgttcggggacatcgtgctgacccagtctccagacacactggctgtgtctcgtgggcgaggagggcccaccatcaactgacaggtccagcgaagtagttattttagaacacgtaacccaaanaagtaacgtaactagttcggtacttggtatcagacaacgaaaccaggacacgacctactaaacgtgtcttactatttagtcggactacgttaccgtaaaaccgggggtaagtttcgggggtccctgtaccgtattcgaggccggntacggcgtgtcgtagggactaagtactttccactctaccacctatccgaagtcccagcctagaccgtaggtacttaggaaacgttggttcggtcggtaccgtttaactagttaacgtacgtaaccaaattaagttatacaacggtaaacgtcgtaacgggtccgtttaccgggccgttaagggtacgtaagggtggaacgntaaccgagtaccgtaagttggttcgntaacgcctaactatcgttacttcttaactccg

SEQ ID NO: 302849 - DNA, 488 bp, Homo sapiens
  misc_feature: GZ8MTXP02JUVYU.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggtgagagggccaccatcaactgcaggtccagcgagagtatttgtacagacccaacagtaagaactacttggcttggtatcagcagaaaccaggacagcctcctaaactgctcatttatggcatctacccgggaattcggggtccctgtccgattcagcggcagcgtgtctgggacagatttcactctcaccatcagcagcctgtaggctgaagatgtggcgtctatactgtcaaacatattatagaaagtccaagggtactttcggcctgggactaggtgagatcagacgaactgtcggctgcacatctgtcttcattccc

SEQ ID NO: 302850 - DNA, 497 bp, Homo sapiens
  misc_feature: GZ8MTXP02FR3N8.19.5.A05.1.454.CMB.2.raw
  modified_base (221)..(221): a, c, t, g, unknown or other
  misc_feature (221)..(221): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccaggacagcctcctaaactgctcattatgggcatctacccgggaaattggggccctgtccgattcagcggcagcgtgctgggacagatttcactctcaccatcagcagcctgcaggctgaagatgtggcggtctattactgtcaaactaatattaatgaaaacgtccgaagggtactttcggccctaggggactaaggtggagatcgaagacgaactgtggctgcaccatctagtcttctac

SEQ ID NO: 302851 - DNA, 604 bp, Homo sapiens
  misc_feature: GZ8MTXP02F6NTE.19.5.A05.1.454.CMB.2.raw
  modified_base (361)..(361): a, c, t, g, unknown or other
  misc_feature (361)..(361): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggtgagagggccaccatcaactgcaggtccagcgagagtatttgtacagaacccaacagtaagaactacttggcttggtatcagcaagaaaccaggacagcctacctaaactgctcatttatgggcatctacccgggaattcgggtccctgtccgattcagcgcagcgtgtctgggacagatttcactctcaccntcagcagcctgtagctgaagatgtggcgtctattactagtacaaaactaattattaataggtaaaaacgtcccgtaagggggtaccttttacccggggaccccttagggggtaaccttaaaaggggtggggaaacgtaagttaccgaaacggaaccgggtaaaacctcggggttaacggggcctttacggaacccgaaaccccgtaagttcccttaggttccctttaccgtaactttcccccg

SEQ ID NO: 302852 - DNA, 549 bp, Homo sapiens
  misc_feature: GZ8MTXP02IRJL8.19.5.A05.1.454.CMB.2.raw
  modified_base (222)..(222): a, c, t, g, unknown or other
  misc_feature (222)..(222): n is a, c, g, or t
  modified_base (431)..(431): a, c, t, g, unknown or other
  misc_feature (431)..(431): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagtatttgacagacccaanagtaagaactacttggcttggatcagcagaaaccagacagcctactaaactgactctatttagttggacagtaccgtaacccgggtaaagttcggggtaccctggtccgtattcagcggcagcgtgtcgtggacagtatttcactctcaccatcagcagcctgcaggctagaagatgtggccgtatattactgtacaaactaatattanagtaaacgtccgaagggtacctttccgggcccgttaggggtaacttaagggtaggagaagtccgaaagaacggtaacgtggtcggactaacgactaaccctagtcctgtcctttacac

SEQ ID NO: 302853 - DNA, 501 bp, Homo sapiens
  misc_feature: GZ8MTXP02JHDET.19.5.A05.1.454.CMB.2.raw
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctacctaaactgctcatttatggcatctacccgggaaattcggggtccctgtccgattcagcggcacgcgtgtctggggacagtatttcactctcaccatcagcagcctgcaggctgaanatgtggcgtactattacngtacaaacattattatagaaagtccgagggtactttcggccgtagggactaagggtgaacgatacgagacgaactggtgctgacacatctgtctctac

SEQ ID NO: 302854 - DNA, 544 bp, Homo sapiens
  misc_feature: GZ8MTXP02GPQEV.19.5.A05.1.454.CMB.2.raw
  modified_base (221)..(221): a, c, t, g, unknown or other
  misc_feature (221)..(221): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccaggacagcctacctaaactgctcatttatggcatcgtaaccgggaaattcggggccctgtccgtattcgagcggcacgcgtgtctgggacagtattcactctcaccatcagcacgcctgcaggctagaagatggtggcgtactattacgtgtaacaactaatattaagtagaaacgtccgaagggttacctttacggcccgttaggggtaactaaggggtggagtatacgaaaggaacgtaactggcggtcctggacctaacgtactcttacggtcctttctaacccg

SEQ ID NO: 302855 - DNA, 595 bp, Homo sapiens
  misc_feature: GZ8MTXP02H2L7W.19.5.A05.1.454.CMB.2.raw
  modified_base (222)..(222): a, c, t, g, unknown or other
  misc_feature (222)..(222): n is a, c, g, or t
  modified_base (389)..(389): a, c, t, g, unknown or other
  misc_feature (389)..(389): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagaggccaccatcaactgcaggtccagcgagagttatttgacagacccaanagtaagaactactggcttggatcagcaagaaaccaggacagcctactaaactgctcatttagtgggacagtacgtaaccccgggtaaagttcggggtaccctggtccgattccgagccggacacgcgtgtcgtggacagtactttcactctcaccatcagcacgccngcgagacgagagtagtgtcggtcgtacgtactactacgtactaactaaataattaagtaagtaaacgtaaccgtaacggttaccgttaccggtaccggtacggtaacggtaaacggtacggtaagtacgtacgaacggaacgtaacgtacggtacggtacgtaacgaccgtaaccgtacgttaccgttacgttaccttacctaccg

SEQ ID NO: 302856 - DNA, 500 bp, Homo sapiens
  misc_feature: GZ8MTXP02HY1KK.19.5.A05.1.454.CMB.2.raw
  modified_base (222)..(222): a, c, t, g, unknown or other
  misc_feature (222)..(222): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (418)..(418): a, c, t, g, unknown or other
  misc_feature (418)..(418): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaanagtaagaactacttggcttggtatcagcaagaaaccaggacagcctacctaaactgctcatttattggcatctaccgggaaattcggggtccctgtccgatcagcggcagcgtgtctgggacagtatttcactctcaccatcagcagcctgcaggctagaagntgtggcgtntattactgtacaaactaatattanagaaacgtccgagggtacttcggccctagggactaaggtgagatacaagacgaacgtgtgctgcaccatctcgtctttacac

SEQ ID NO: 302857 - DNA, 529 bp, Homo sapiens
  misc_feature: GZ8MTXP02GHHEC.19.5.A05.1.454.CMB.2.raw
  modified_base (222)..(222): a, c, t, g, unknown or other
  misc_feature (222)..(222): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaanagtaagaactactggcttggtatcagcaagaaaccaggacagcctacctaaactgctctaatttattgggctatccgtaaccccggggtaaattcggggtaccctgtccgtattcgagcggcagcgtgtctggggacagtactttcactctacaccatcagcagcctgcaggctgaagntgnggcgtactagttactgtacaaactaatattatagaaagtccgagggtacctttcggacccgttaggggaactaagggtcggaagatcgaagacgaactggtaggctgcaccatctcgtcttctac

SEQ ID NO: 302858 - DNA, 498 bp, Homo sapiens
  misc_feature: GZ8MTXP02GX2I0.19.5.A05.1.454.CMB.2.raw
  modified_base (222)..(222): a, c, t, g, unknown or other
  misc_feature (222)..(222): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaanagtaagaactacttggcttggtatcagcagaaaccaggacagcctacctaaactgctcatttatggcatctaccggaaattggggtccctgtccgattcagcggcacgcgtgtctgggacagatttcactctcaccatcagcagcctgcaggctagaagatggtggcggtctattactgtacaactaatattatagaaagtccagggtacttcggcctagggactaaggtgagatcgagacgaacgtcgtggctgcacctatctacgtcttactac

SEQ ID NO: 302859 - DNA, 504 bp, Homo sapiens
  misc_feature: GZ8MTXP02G56UN.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctcctaaactgctcatttattgggcatctaccggaaattggggtccctgtccgattcagcggcagcgtgtctgggacagatttcactctcaccatcagcagcctgcaggctgaagatggtggcggtctagttactgtacaactaatattatagaaaagtccaagggtctttcggccctggggaactaagggtcggagatcgaagacgaacgtgtggctgcactagtctcgtacttctac

SEQ ID NO: 302860 - DNA, 500 bp, Homo sapiens
  misc_feature: GZ8MTXP02IRXTJ.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcattattggcatctaccggaaattggggtccctgtccgattcagcggcagcgtgtctgggacagattcactctcaccatcagcagcctgcaggctgagatgtggcggtctattactgttacaaactaattattatagaaaagtccaaggggtactttcgggccctagggactaaggtggagatcgaagacgaactgtaggctgcacactctcgtcttctac

SEQ ID NO: 302861 - DNA, 504 bp, Homo sapiens
  misc_feature: GZ8MTXP02G80IQ.19.5.A05.1.454.CMB.2.raw
  modified_base (482)..(482): a, c, t, g, unknown or other
  misc_feature (482)..(482): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaaacagtaagaactacttggcttggtatcagcagaaaaccaggacagcctcctaaactgctcatttatgggcatctaacccgggaaattggggtccctgtccgattcagcggcagcgtgtctgggacagatttcactctcaccatcagcagcctgcaggctgaaagatgtggcggtctaattactgtacaaacaaatattaagtacgaaaagttccgaagggtctttacggccctagggactaaggtgagatcaagacgaacngtggctgcacactctctctctc

SEQ ID NO: 302862 - DNA, 576 bp, Homo sapiens
  misc_feature: GZ8MTXP02G2DZ8.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcagaaaccaggacagcctacctaaactgctcatttattggcatctacccgggaaattcggggtccctgtccgattcagcgcagcgtgtctgggacagatttcactctcaccatcagcagcctgcaggctagaagatggtggcggtctattactgtacaaactaatattatagtaaacgtccgaaggggtactttaccgggacccgttaggggaaaccgttaaggggtacggtaaggtacgttaccgaaaggtaaccgtaaaccgtgggttaacggcgttaacggaccaacccgtacgttccttacggtttccctttacgttaacccg

SEQ ID NO: 302863 - DNA, 513 bp, Homo sapiens
  misc_feature: GZ8MTXP02JJE9S.19.5.A05.1.454.CMB.2.raw
  modified_base (347)..(347): a, c, t, g, unknown or other
  misc_feature (347)..(347): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcagaaaccaggacagcctacctaaactgctcatttatggcatctaccgggaattggggtccctgtccgattcagtcggcagcgtgtcgtgggacagtntttcactctcaccatcagcacgcctgcaggctagaagtatggtggcggttactattactgtacaactaattattatagaaagttccgagggtacttcggcccttgggactaaggtgagatcgaagtacgaacgtgtacggctaagcacctagtctcgtcttctacg

SEQ ID NO: 302864 - DNA, 556 bp, Homo sapiens
  misc_feature: GZ8MTXP02J36W6.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagtatttgacagaaccccaacagtaagtaactacttggcttggtatcagcaaagaaaccaggacacgcctacctaaactgctctatttagttgggcactccgtacccgggtaaattcggggtccctgtccgtattcgagcggcacggcgttgtcgtaggggactagtactttcactctacaccatcagcagccctgcaggctagaagtagtggtggtcggttacttattactattaccaataattataagtagaaacggtccgagggtaccttcgggccgtacggggaacgtaaggtaggagatacgacgacgtaaccgtgtcggctcgcacctactcttcttcttcttaccc

SEQ ID NO: 302865 - DNA, 487 bp, Homo sapiens
  misc_feature: GZ8MTXP02GOB5A.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctacctaaactgctcatttatggcatctacccggaaattggggtccctgtccgattcagcggcagcgtgtctgggacagatttcactctcaccatcagcagcctgcaggctgaagatgtggcgtctattactgtacaactaatattatgaaagtccgagggtactttcggcctagggactaaggtgagatcgagacgactgagctgcacatctgtcttctac

SEQ ID NO: 302866 - DNA, 608 bp, Homo sapiens
  misc_feature: GZ8MTXP02FMD7J.19.5.A05.1.454.CMB.2.raw
  modified_base (372)..(372): a, c, t, g, unknown or other
  misc_feature (372)..(372): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttattttgacagaacccaacagtaaagaactacttggcttggtatcagcagaaaccaggacagcctacctaaactgctctatttagtggcatccgtaacccgggaaattcggggtccctgtccgtatcgagcggcagcgtgtcgtgggacagtatttcactctcaccntcagcacgcctgcgaggctagaagagtggtcgggtacgttacttaattacgtgtaacaaactaattaattaagtagtaaaacgtccgaaggggtacctttccgggacccgttagggggtaaaccgtaaaggggtacggaaggtaacgtacgaaacggtaaaccgtaaaccgttgggtacggccttaacggaccctaaacccgtagtttcctttcggttaccctttccgttaacccg

SEQ ID NO: 302867 - DNA, 554 bp, Homo sapiens
  misc_feature: GZ8MTXP02F8MES.19.5.A05.1.454.CMB.2.raw
  modified_base (221)..(221): a, c, t, g, unknown or other
  misc_feature (221)..(221): n is a, c, g, or t
  modified_base (389)..(389): a, c, t, g, unknown or other
  misc_feature (389)..(389): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagactacttggcttggtatcagcagaaaccaggacagcctacctaaactgctcatttatggcatctacccgggaaattcggggtccctgtccgtattcgagcggcagcgtgtcgtgggacagtatttccactctacaccatcagcagcctgcaggctagaaagntaggtggtcggtactagttactagtacaaactaattattactagaaacgtccgaaggggttacctttaccgggcccgtaggggtaaccgttaaagggtggaaggtactacgaaggaaccgtaacgtggtggacctgcctaaccgtatccgtagtcctttactacc

SEQ ID NO: 302868 - DNA, 527 bp, Homo sapiens
  misc_feature: GZ8MTXP02H7S3E.19.5.A05.1.454.CMB.2.raw
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (502)..(502): a, c, t, g, unknown or other
  misc_feature (502)..(502): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggatcagcaagaaaccaggacagccctacctaaactgctctaattttagtggacataccgtaacccggggtaaattcggggtccctgtccgattcgagcggcacgcgtgtcngggacagactttcacttcacaccatcgancagtccngcagcngaagngtgngcgtctatactgtacaataatatatagaaacgtccgagggtaccttcgggacccgttaggggacgtaaagggtggaacgtatacgagacgtaactcggngctgcacctatcctgtcttacgacc

SEQ ID NO: 302869 - DNA, 516 bp, Homo sapiens
  misc_feature: GZ8MTXP02IFQ94.19.5.A05.1.454.CMB.2.raw
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
  modified_base (476)..(476): a, c, t, g, unknown or other
  misc_feature (476)..(476): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcagggtccagcgagagtattttgacagacccaacagtaagaactacttggcttggtatcagcaagaaaccnggacagcctacctaaactgctctatttattgggcatcgtaaccgggaaattcggggtccctgtccgattcgagcggcagcgtgtcgtgggacagtactttcactcncaccatcagcagccngcaggctagaagtatggtggcgttactagttactagtacaaactaattattanagaaacgtccgaggtcttcggccgtaggacgtaaggtgagtntacgagaacgactggtgctgcaacctatctcgtctactac

SEQ ID NO: 302870 - DNA, 598 bp, Homo sapiens
  misc_feature: GZ8MTXP02J1751.19.5.A05.1.454.CMB.2.raw
  modified_base (223)..(223): a, c, t, g, unknown or other
  misc_feature (223)..(223): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagttatttgacagacccaanagtaagactacttggcttggtatcagcaagaaaccaggacagccctacctaaactgctctatttatgggctatccgtaaccgggaattcggggtccctgtccgatcgagcggcagcgtgtcgtgggacagtattccactctcaccatcagcgactcgtgacgagtcgtaagagtgttcgggtcggtacgttacttaacgttacgtactaaaccaaacttaattaacgttaaggtaaacggtaaccgtaccggttacgggttacccggttacccgggtaccggtagggtaaacggtagggtacggaagtacgtacggaaacggtaacgtacgtcggtacggctcgaccctactcgtacgttcgttccttactcccg

SEQ ID NO: 302871 - DNA, 541 bp, Homo sapiens
  misc_feature: GZ8MTXP02I98SP.19.5.A05.1.454.CMB.2.raw
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (523)..(523): a, c, t, g, unknown or other
  misc_feature (523)..(523): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagtattttgacagacccaanagtaagactacttggcttggatcagacagaaaccnggacagcctacctaaactgactacatttagtgggacataccgtaacccgggtaaattcggggtaccctgtccgattcagcggcagcgtgtctggacagtattcactctcaccatcagcancctgcaggctagaaantgtggcgtctattacngtacaaactaataattataagaaaacgtccgtaagggtacctttcgggacccgtagggtaactaagggtcgaagatacgaaagaaccgtaacgtcgtggactaagctaacctnttcctacgttctactacg

SEQ ID NO: 302872 - DNA, 613 bp, Homo sapiens
  misc_feature: GZ8MTXP02HVY6M.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggatcagcaagaaaccaggacagcctacctaaactgctctatttagtggcataccgtaaccgggaattcggggtccctgtccgtattcgagcggcacgcgtgtcgtggacagtattcactctcacctatcagcacgcctgacaggctagaagtagtggtcgggacgttctaattacgttagtaacctaaactaaatttaagtttaagtaacggtaaaacggtcccgtaaagggggttacccgttttaccggggaccccgttagggggtaaaccgttaaaggggttacggaagtacgtacgtaaacggtaaaccgtaacgtggtacggtacgtaacggacctaaccgtacgtcttcggttactttactacccg

SEQ ID NO: 302873 - DNA, 556 bp, Homo sapiens
  misc_feature: GZ8MTXP02HIOFH.19.5.A05.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (267)..(268): a, c, t, g, unknown or other
  misc_feature (267)..(268): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaaanagtaanactatgnttgancagcaagaacagacacnccactaannctatattagtggacatacgtaaccggtaaagttcgggtccctgtaccgatcagcgcacgcgtgtcgtaggacagtattcactcaccaccatcanacacnccncgacgacgacgtagaagagtgtggtcggtacgttacttactacgtactaaactaaataattaataagtaaacgtacgtacggtacgttacggtaccgtacggtaacggtaaacggtacggtagagtacgaacgaaacgtaacgtacgtacggtacgtcgacgacctactactacgttacttactac

SEQ ID NO: 302874 - DNA, 523 bp, Homo sapiens
  misc_feature: GZ8MTXP02IVHUJ.19.5.A05.1.454.CMB.2.raw
  modified_base (222)..(222): a, c, t, g, unknown or other
  misc_feature (222)..(222): n is a, c, g, or t
  modified_base (506)..(506): a, c, t, g, unknown or other
  misc_feature (506)..(506): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttatttgacagacccaanagtaagaactacttggcttggtatcagcagaaaccagacagcctactaaactgctcatttattggcatccgtaacccgggtaaaagttcggggtaccccttggtaccgattcaggcggtcacgtcgtgtcgtgggacagtattcactctcaccatcagcagcctgcaggcagaagagtgtcggtcgtactattacgtgtacaaactatatatagaaagtcgaggtcttcggccgtaggacgtaaggtcgagtactacgaagacgacgtggtcgactcggcaacnctctcgtccttactacc

SEQ ID NO: 302875 - DNA, 643 bp, Homo sapiens
  misc_feature: GZ8MTXP02FD7VH.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggtgagagggccaccatcaactgcaggtccagcgagagttatttgacagacccaacagtaagaactactggctggtatcagcagaaaccaggacagcctactaaactgctctatttagtgggacatccgtaaccgggtaattcggggtccctgtccggattcgaggccggcacgcgttgcgtagggactagtactttcactctacaccatcagcagcctgtaggctagaagtatggtaggcggttactaatttacctaggttaccaaaactaaagttaattaaacgtacgggtaaaagtccccggtaaggggtaaccgttttccgggaccccgtaagggggtaaccgtttaaaaggggtgggaaaaggttaactacccgaaaagggaaaacccgtaaaaccgttgggttacggggccttacggaaccgaaccccgtaaattcgttactttacccttaccgtacttttaccccccgg

SEQ ID NO: 302876 - DNA, 506 bp, Homo sapiens
  misc_feature: GZ8MTXP02H4VYQ.19.5.A05.1.454.CMB.2.raw
  modified_base (221)..(221): a, c, t, g, unknown or other
  misc_feature (221)..(221): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactactggcttggatcagcaagaaaccaggacagcctacctaaactgctctatttattgggcatccgtaacccggggtaaattcggggtccctgtccgattcagcggcacgcgtgtcgtgggacagtatttcacttctaccaccatcagcagcctgcaggtcngaagatggnggcgttctattacngtacaactaatattanagaaagtccaggtacttcggacctggactaggtganatcagtacgagtcgtagctgctaaccgtntctcgtctcnc

SEQ ID NO: 302877 - DNA, 645 bp, Homo sapiens
  misc_feature: GZ8MTXP02FNI8S.19.5.A05.1.454.CMB.2.raw
  modified_base (225)..(225): a, c, t, g, unknown or other
  misc_feature (225)..(225): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagtactctcgtgcacgaccggtgctcgatttagatagatagacaggcaggggcagcaagatggtgttgcagacccaggtcttcatttctctgttgctctggatctctggtgccgttcggggacatcgtgctgacccagtctccagacacactggctgtgtctcgtgggcgagagggccacatcaactgcaggtccagcgagagttatttgacacgaacccaanaagtaaagaacttacgttggtcttaggtatcaagcaagaaaccaggacacgacctacctaaactgtacctactaatttagtcgggactacgtacccggtaaacccggggtaaagtttccggggtacccttggtaccgtaattccgaggtccggcacggtcggttcgtacgtaggggactagttactttccactctacacctatacagcacgccctaggacaggntagaagntgggtcgggtcttactattacgtagtaaacaaactaataatttaagaagtaaaccgtcggaacgggttaccttccggggaccgtaggggaacgtaaggggtagaaggtacgtaacgaaacggtaaccgtaaacgttggcgttaaacccggtaacgacctaacgtacttcgttacgttaccttactaccg

SEQ ID NO: 302878 - DNA, 544 bp, Homo sapiens
  misc_feature: GZ8MTXP02IZIDR.19.5.A05.1.454.CMB.2.raw
  modified_base (220)..(220): a, c, t, g, unknown or other
  misc_feature (220)..(220): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctctgggcgagagggccacatcaactgcaggtccagcgagagtattttgacagacccaanagtaagaactacttggcttggtatcagcagaaaccaggacagcctacctaaatcgtactctatttagttggactatcgtaccggtaattcgggtccctgtccgattcgagcggacacgtcgtgtcgtagggactaggtactttcacgtctcacctatcagctagcctgacaggctagaaagcgttggtcggtcgtactagttactgtacaaactattattagagaaacgtcgaggtacttcggccgtaggactaaggtcgatactcgaagtacgtaacgtcggtcgcgtaacgtaccgtactacgttcgtcgttacctctaccg

SEQ ID NO: 302879 - DNA, 746 bp, Homo sapiens
  misc_feature: GZ8MTXP02IE6T3.19.5.A05.1.454.CMB.2.raw
  modified_base (222)..(222): a, c, t, g, unknown or other
  misc_feature (222)..(222): n is a, c, g, or t
  modified_base (469)..(469): a, c, t, g, unknown or other
  misc_feature (469)..(469): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtgggcgagacggccacatcaactgcaggtccagcgagagttatttgacacgacccaanaagtaagaacttacgttggtcttaggtatcgagacaacgaaaccaggaacacgtaccctaacctaaactcgtaccttactaattttagttcgggactaacgttacccggtaaccccggggtaaaagtttccggggtaccccttggttaccgagttaccgaacggtccggacgtacggtccggttcggtcggtacggggaactacggttactttccacttctacccaacctatcaacgccacgtccgngacgacggtacgtaagaacgtacggttcggtacgggtaccgttaacttaacgttaaccgttacgtaaactaaaacttaaagttaaacgtttaaggtaaaccgtaaacggttaccggttaacgggtttaccggtttcccgggtaccggtttaacggggaaacgttaacggggtacggaaacgtacgtaaacgtaaacggtaaaccgttaacggttcgggtaacgacgtaacgaaccgtaaccttacgtttaccgtttacgtttaccgtttacctaccg

SEQ ID NO: 302880 - DNA, 605 bp, Homo sapiens
  misc_feature: GZ8MTXP02F25SC.19.5.A05.1.454.CMB.2.raw
  modified_base (223)..(223): a, c, t, g, unknown or other
  misc_feature (223)..(223): n is a, c, g, or t
  modified_base (358)..(358): a, c, t, g, unknown or other
  misc_feature (358)..(358): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttattttgacagacccaanagtaagaactacttggcttggtatcagcaagaaaccaggacagcctacctaaactgctcatttagtgggacatccgtaacccggggaaattcggtcgtccctgtccgattcagcggcagcgtgtcgtggacagtntttcacttctaccacctatcagcagccctgcaggctagaagtagtggtcggcgttactatttaccgtgttaccaaaactaattaatttaagacgtaaaacgttcccgtaaaggggtaaccttttccggggaccccgttagggggtaaccgtaaagggggttcggaaagtacgttacgaaacggtaaccgtaaacgtggttacgggccttacggacccaaccgtattccgttacggtttcctttaccg

SEQ ID NO: 302881 - DNA, 598 bp, Homo sapiens
  misc_feature: GZ8MTXP02IKSP5.19.5.A05.1.454.CMB.2.raw
  modified_base (224)..(224): a, c, t, g, unknown or other
  misc_feature (224)..(224): n is a, c, g, or t
  modified_base (425)..(425): a, c, t, g, unknown or other
  misc_feature (425)..(425): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagttattttgacagacccaanagtaagaactacttggcttggtatcagcaagaaaccaggacagccctacctaaatgctactatttagttggactagtaccgtaacccggggtaaaagttcggggtaccccttggtacccgtattccgaggccggcacggcgtgtcgtgggacagtactttccactcctaccaccatacagcacgctgcaggtctagaaagngtgtaggcgttacttatacgtgtaacaaactaatattagtagaacgtaccgtacggtacttcgggacccgtagggtaaccgttaaaggtggaaacgtacgtacgaaacggtaaaccgtaaacgtcggttaggacgtcgacctaccgtacgtacttcgttacctttactacccg

SEQ ID NO: 302882 - DNA, 552 bp, Homo sapiens
  misc_feature: GZ8MTXP02IT4DP.19.5.A05.1.454.CMB.2.raw
  modified_base (388)..(388): a, c, t, g, unknown or other
  misc_feature (388)..(388): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctacctaaactgctcatttatggcatctaccggaattcggggtccctgtccgattcagcggcagcgtgtctggggacagtacttcactcgtccaccatcagcacgcctgcaggctagaaagntggtcggcggtactattactgtacaaactaattacttataagaaacgtaccgaagggtacgtttccggacccgtagggtaactaaaggggtcgaaggtacttacgaaacgacggtaaacgttcggtaggccttggaccaacgtactctcgttacttacttaccg

SEQ ID NO: 302883 - DNA, 541 bp, Homo sapiens
  misc_feature: GZ8MTXP02HO5WS.19.5.A05.1.454.CMB.2.raw
  modified_base (221)..(221): a, c, t, g, unknown or other
  misc_feature (221)..(221): n is a, c, g, or t
  modified_base (413)..(413): a, c, t, g, unknown or other
  misc_feature (413)..(413): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactactggcttggtatcagcaagaaaccaggacacgcctacctaaactgctctatttagtcggcatccgtaacccgggaaattcggggtaccctggtccgattcaggcggcaggcgtgtcgtagggacagtattcactctcaccatcagcagcctagcaggctagatagtgtggcgtctattacngtacaaactaatattagtagaaacgtacgacgggttactttcggacccgtgggaactaagggtacggagtatacgaaggtacgaacgtggtacgcgtaacgacctacacgtaccgtctctttacaccg

SEQ ID NO: 302884 - DNA, 534 bp, Homo sapiens
  misc_feature: GZ8MTXP02INWCL.19.5.A05.1.454.CMB.2.raw
  modified_base (222)..(222): a, c, t, g, unknown or other
  misc_feature (222)..(222): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagtattttgacagaccaanagtaagactattggcttggtatcagcagaaaccaggacagcctacctaaactgctactatttagttgggcaagttccgtaacccggggtaaaagttcggggtaccccttggtcccgatttcgagcggcagcgtgtcgtggggacagtatttcactctcacccatcagcagcctgcaggctagaagactgtggcgttctattactgtacaaacgtattattatagaaacgtcgaagggtctttacggcctagggactaaggtggacgtatcgaagacgtaactggtgctgccactctactcgtcttactaccg

SEQ ID NO: 302885 - DNA, 542 bp, Homo sapiens
  misc_feature: GZ8MTXP02GH526.19.5.A05.1.454.CMB.2.raw
  modified_base (221)..(221): a, c, t, g, unknown or other
  misc_feature (221)..(221): n is a, c, g, or t
  modified_base (400)..(400): a, c, t, g, unknown or other
  misc_feature (400)..(400): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactattggcttggtatcagcaagaaaccaggacagccctacctaaactgactactatttagtggactagtaccgtaaccggtaagttcggggtccctgtccgattcgagcgcagcgtgtcgtggacagtacttcactctacaccatcagccagcctagcgaggctagaaagntggtggcgtatattactgtacaaactaattattagtagaaacgtcgaggtacttcggaccgtagggtaacgtaaggtagaagacgtacgaaggtacgtaacgtggtacgactaacgaccactactcgtacgtcttactaccg

SEQ ID NO: 302886 - DNA, 523 bp, Homo sapiens
  misc_feature: GZ8MTXP02F6851.19.5.A05.1.454.CMB.2.raw
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagccctacctaaactgctactatttagttgggacatcctacccgggtaaattcggggtccctgtccgattcagcggcagcgtgtctgggactagatttcactctcgaccatcagcagtccngcagntagagtntgtgcgtntatatnacaatatatanagaacgtcgagtcgttcgccgtaggaacgtaggtaggacgatacgaacggtaacgtaacgtcgtacggtctaacgactaaccgtattcgtacgtactttacac

SEQ ID NO: 302887 - DNA, 497 bp, Homo sapiens
  misc_feature: GZ8MTXP02GA7R9.19.5.A05.1.454.CMB.2.raw
  modified_base (405)..(405): a, c, t, g, unknown or other
  misc_feature (405)..(405): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcagaggaccaccatcaactgcaggtccagcgagagtattttgacagacccaacagtaagaactacttggcttggtatcagcagaaaccaggacagcctcctaaactgctcatttagttgggcatcctaccgggaaattcggggtccctgtccgattcagcggcagcgtgtctgggacagtatttcactctcaccatcagcagcctgcaggctagaagatgtgggcgttactattacngtacaacaatattatagaaacgtcgaggtactttcggcccgtagggactaaggtgagatcaagacgaactggngctgcacntcngtctctac

SEQ ID NO: 302888 - DNA, 502 bp, Homo sapiens
  misc_feature: GZ8MTXP02FNZDO.19.5.A05.1.454.CMB.2.raw
  modified_base (221)..(221): a, c, t, g, unknown or other
  misc_feature (221)..(221): n is a, c, g, or t
  modified_base (413)..(413): a, c, t, g, unknown or other
  misc_feature (413)..(413): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccaggacagcctactaaactgctcattattggcatccgtaccgggaaattggggtccctgtccgattcagcggcacgcgtgtctgggacagatttcactctcacatcagcagcctgcagctgaagatgtggcgtactattactgtacaactaatattanagaaaacgtcgagggtactttcggccctagggacgtaagggtcgagatcgacgacgaacgtgtaggctaaggcacatcgtagtctctac

SEQ ID NO: 302889 - DNA, 512 bp, Homo sapiens
  misc_feature: GZ8MTXP02HSZT1.19.5.A05.1.454.CMB.2.raw
  modified_base (221)..(221): a, c, t, g, unknown or other
  misc_feature (221)..(221): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagactactggcttggtatcagcagaaaccaggacagcctacctaaactgctcatttatggcatctacccggaaattcggggtccctgtccgattcgagcggcagcgtgtctggggacagatttcactctacaccatcagcagcctgcaggctgaagatgtggcgtntattactgtacaaatatattanagaaagtccaggtacttcggcctagggactaaggtggaagatacgaaggacgaaacgtggtacggctcggcaaaccttactcgttacgttccttactac

SEQ ID NO: 302890 - DNA, 521 bp, Homo sapiens
  misc_feature: GZ8MTXP02JGNPT.19.5.A05.1.454.CMB.2.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactactggcttggtatcagcagaaaccnggacagcctactaaactgctntatttatggcataccgtaccgggaattcggggtccctgtccgattcgagcggcagcgtgtcgtgggacagtactttcactctccaccntacagcagcctgcagctagaangtgtggcgtactattactgtacaactaatattagagaaacgtccgagggttacttcggacccgttagggactaagggtgagatacgagaacgtacgtgtcggactgactaacctgttcctcgttccttctaccg

SEQ ID NO: 302891 - DNA, 547 bp, Homo sapiens
  misc_feature: GZ8MTXP02JKF27.19.5.A05.1.454.CMB.2.raw
  modified_base (386)..(386): a, c, t, g, unknown or other
  misc_feature (386)..(386): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctacctaaactgctcatttatgggcatccgtaccgggaaattcggggtccctgtccgattcagcggcagcgtgtctgggacagatttcactctcaccatcagcagcctgcaggctagaagntggtggcgtctattactgtacaaactaattattagagaaaacgtccgaagggtacctttcggacccgttagggaacgtaagggtggaagtagtcgaacggaacgtaacgttggtcggtactcggacctaacccgtattccgttacgttaccttactaaccg

SEQ ID NO: 302892 - DNA, 602 bp, Homo sapiens
  misc_feature: GZ8MTXP02FRSAT.19.5.A05.1.454.CMB.2.raw
  modified_base (271)..(271): a, c, t, g, unknown or other
  misc_feature (271)..(271): n is a, c, g, or t
  modified_base (460)..(460): a, c, t, g, unknown or other
  misc_feature (460)..(460): n is a, c, g, or t
  modified_base (553)..(553): a, c, t, g, unknown or other
  misc_feature (553)..(553): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccaccatcaactgcaggtccaaagcgagtagttattttgaacacgaacccaacagtaagaacttacgttggcttggtatcagacaagaaaccnggacacgccctacctaaatcgcttctaattttgtgggactagttacccggtaaccccggggtaagtttccggggtccccttggtccgtaattcgaggccggtacacggtccgtggtcgtaggggtaactagttactttccaccttctaccaccgtatacccgagccagccctgaccgaggcgtagaagngtggtcggtcgttactatttacgtataaccaataattacttagagtaacgtcgtacggtactttccgggacctaggggaacgtaagggtgganacgtacgacgtaacgagttggnggtacncgactactcgtctctctctcg

SEQ ID NO: 302893 - DNA, 570 bp, Homo sapiens
  misc_feature: GZ8MTXP02GVC3O.19.5.A05.1.454.CMB.2.raw
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggtatcagcaagaaaccaggacagcctacctaaactgctctatttattgggcatccgtaccgggtaaattcggggtccctgtccgattcagcggcagcgtgtctgggacagactttcactctcaccntcagcagcctgcaggctgaaacgntggtggcggtactagttactgtacaacgtaatattacgagtaaacgtccgagggtactttacggcccgttaggggaacgtaagggtcggaagtacgtacgaaacggtaaccgtaaaccgttggtcggtaccgttaacggaccgtaacccgtatccgtttcggttaccttcgttaacccg

SEQ ID NO: 302894 - DNA, 485 bp, Homo sapiens
  misc_feature: GZ8MTXP02FNJYC.19.5.A05.1.454.CMB.2.raw
  modified_base (222)..(222): a, c, t, g, unknown or other
  misc_feature (222)..(222): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (458)..(458): a, c, t, g, unknown or other
  misc_feature (458)..(458): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaanagtaagaactactggcttggtatcagcagaaaccaggacagcctacctaaactgctcatttatgggcatctacccggaaattcggggtccctgtccgattcagcgcagcgtgtctgggacagatttcactctcaccatcagcagctgcagctgaagntgngcgtatattcngtacaataatatatagaacgcgaggtcttcgcgtaggacgtaaggtgagatacagacgtacgtgngctcgacactatcgtcgtccttacacg

SEQ ID NO: 302895 - DNA, 579 bp, Homo sapiens
  misc_feature: GZ8MTXP02GWFXJ.19.5.A05.1.454.CMB.2.raw
  modified_base (278)..(278): a, c, t, g, unknown or other
  misc_feature (278)..(278): n is a, c, g, or t
  modified_base (395)..(395): a, c, t, g, unknown or other
  misc_feature (395)..(395): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggatcagcagaaaccaggacagcctacctaaactgctntatttagttgggctatccgtaacccgggtaaagttcggggtccctgtccgtattcgaggcggcacggtcgtgtctaggggactagtacttcgactctaccactatcagcagcctgcnggctagagagtgtcggcgtctattactgtaacaactaattattagtaagtaaacgtccgtaagggtacctttccgggaccgttaggggaacgtaagggtggaacgtacgtacgaacggtaacgtaacgtggtacggacttaacggacctaaccgtacttaccgtcgtttaccttacgttaaccc

SEQ ID NO: 302896 - DNA, 566 bp, Homo sapiens
  misc_feature: GZ8MTXP02IY676.19.5.A05.1.454.CMB.2.raw
  modified_base (225)..(225): a, c, t, g, unknown or other
  misc_feature (225)..(225): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtgggcgagagggccaccatcaactgcgaggccagcgagagttattttgacacgaacccaanagtaaagaacttacttggcttaggtatcagcaagaaaccaggacacgacctacctaaactgctctatttagtcggactagtaccgtaaccggtaagttcgggtaccctgtccgtattcgagcggcacgcgtgtcgtaggactagtactttcacttctaccgaccntacgagcacgtcngcagactagaangtgtcgacgttactattacgtactacaaattaagttaatactaagtaaacgtaccgtagggtaccgtttcggaccgttaggaacgtaggtagactagtaccgagaacgtacgtgcgtacgtaacgactacacgttctcgttcttaccgtcc

SEQ ID NO: 302897 - DNA, 617 bp, Homo sapiens
  misc_feature: GZ8MTXP02IMU6C.19.5.A05.1.454.CMB.2.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagttatttgacagacccaanagtaagaactacgttggcttggtatcagacaagaaaccaggacacgcctacctaaactgctactatttattcgggactaacgtccgtaaccgggtaaagttcggggtcccctggtccgattcgagcggnacgcgtgtcgtagggacagtactttcacttctacacctatacgacgcacgcctgacgaggctagaacgtgttcggtaggtcgtactacttacgtagtaacaaactagtttaacttaagtacggaaacgtaccggtaaggggttacctttaccggggcccgttaaggggtaactaagggggttacgacgtagtaccgtaaacggacgtaacgttcggtcggacgttaacggacctaaccgtagtcttcgtttaccttactaacccg

SEQ ID NO: 302898 - DNA, 656 bp, Homo sapiens
  misc_feature: GZ8MTXP02FZ958.19.5.A05.1.454.CMB.2.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccnggacagcctacctaaactgctctatttagtggcatcgtaacccgggaattcggggtccctgtccgattcgagcggcacgccgtgtcgtgggacaggtactttcactctacacctatcagcacgcctgctaggctagaagagtggtggtcggtactaagtttaccgtggtaccaaaactaattacgtttaagtagtaaaaccggttccgtaaacggggttaccgtttttaccgggaccccggttaagggggtaaaccgttaaaagggggttacggaaagggttaaacttacccgggtaaaaggaaaccgggtaaaaccgtttaggggttcgggaccttaacggtaccccgaaacctaacggtttccgtttaccggtttaccgtttaccgtttaaaccccg

SEQ ID NO: 302899 - DNA, 708 bp, Homo sapiens
  misc_feature: GZ8MTXP02F9Z13.19.5.A05.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagagggccaccatcaactgcaggtccagcgagagttatttgacagacccaanagtaanactacgtggctggtatcagacaacgaaaccgaggaccggacctacctaaactgactactatttagtgggactactaccgtaacccgggtaaagtttcggggtacccctaggtacccgtagttccgacggccggactacggtcccgttcgtccgtaggggaactagttactttccaccttcctaccaaccactcaacgcacgccctgaccgaggactaggaaagtgtgggtcggtaccggttattaacgttacgtaacgtaacccaaaacttaaactttaagttaacgtaaaggtaaaaccggttaccccgtaagggggttaccccgttttacccgggacccggttaggggtaaaccgttaaacgggggtaggtaaacgtacgttaccggaaacggtaaaccggtaaacgttgggtacggaccgttacggaaccctaacgttaacttccgttacgttaccttaccgtaacctttcccccg

SEQ ID NO: 302900 - DNA, 841 bp, Homo sapiens
  misc_feature: GZ8MTXP02GDNBG.19.5.A05.1.454.CMB.2.raw
  modified_base (221)..(221): a, c, t, g, unknown or other
  misc_feature (221)..(221): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaanagtaagaactacttggcttggtatcagcagaaaccaggacacgcctactaaactgacttctaatttagttgggactacgtacccgtaaaccccggggtaaagtttcgggggtacccccttaggtcccggtaactttaccgaaggccgggtacaccggtccggtgtaccgtaggggacctaaggttaacttttcccgacttcctaccgaaccccacttacgacggacctaaccgcccgttggacccgtacgggtaccgttaaggaaaacggtacggtttgggttacgggggtaccgggtttaccgtttaaacgtttacccgttaagggtttaaaccctaaaaacctttaaaagtttaaccttttaaagggttaaacggtaaaaaccggggtttaccccgggtaaaacgggggtttaaccccggtttttaccccgggggtaaaccccccggtttaaggggggttaaacccggttaaaagggggttaccggggtaaaagggtaaaccggttacggaaaacgggtaaccggtaacggtttacgggtacgggggtacccttaacggggaaccctaacccggttaacttaccgtttccggtttaccctttaccggtttaacccccg

SEQ ID NO: 302901 - DNA, 615 bp, Homo sapiens
  misc_feature: GZ8MTXP02JEXS7.19.5.A05.1.454.CMB.2.raw
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccaccatcaactgcaggtccagcgagtagttatttagacagacccaacagtaagaactacgttggcttggtatcagacaagaaaccgaggacacgacctacctaaaactgtactactaagtttgttacgggactaacgttacccgtaaacccggggtaaagttccggggtacccctggtcccgtaattccgagcggtcagtcgtgtcgtaggacagtatttcacttccacaccntcacgctacgcctgcaggctagaagntggnggtcgtctattacngtacaaatagtattagtacgtaacgtcggacgggtaccgttacggcccggtaaggggtaaccgtaggggtacggtaacgtacgtaccgaaaggtaaccgtaacgttacggcgttaacgcggaacctaacggtacttcgttcgttacctttcgttaaccc

SEQ ID NO: 302902 - DNA, 858 bp, Homo sapiens
  misc_feature: GZ8MTXP02G0ZKE.19.5.A05.1.454.CMB.2.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttattttgacagacccaacagtaagaactacgttggcttggtatcagcaagaaaccaggacagaccctactaaactgacttactatttagttgggctaacgtaccgtaaccgggtaaacgtttcggggtaccccttggtaccgtagtttccgaggccggtacacggtccggtagttcgtaggggtaccaggttaacttttccgaaccttcctacccaaaccctacttaccgaacggtcccaaacgtccccgttaggacccgtaaacggggtccctttaaggggaaaacggttacggttgggggttaaccgggggtacccgggttttaacctttaaacgttttaaacccgtttacgggtttaaaccctaaaaacgtttaaaacgtttaaagttttaaaaggttaaacgggttaaaaaaccgggtttccccggggtaaaacgggggttttaaccccgtttttcccccgggggtacccccggtttaaaggggggtaaaacccggtttaaaacgggggtttagggggaaaaccgtaaacggttaccggaaaaacggggtaacccggttaaaaccggttgggggttaccggtaaccgttaacggaacccgttaaacccttacggtttccctttacggtttacccgtttaccttaacccg

SEQ ID NO: 302903 - DNA, 541 bp, Homo sapiens
  misc_feature: GZ8MTXP02J0LDE.19.5.A05.1.454.CMB.2.raw
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcaagaaaccaggacacgacctacctaaactgctactatttagtggcatccgtaacccgggtaattcggggtaccctgtccgattcagcgcagcgtgtcgngggacagtattcactctccacatcagcagcctgaccnggctgaagacgtggtggtccggttctacttactgtaccaaagtaattattagtagaaacgtccgaacgggtctttccggccgtagggggtactaagggtaggagactacgagtaaccgagtacggtggctgccactactcgtcgtcttactaccc

SEQ ID NO: 302904 - DNA, 605 bp, Homo sapiens
  misc_feature: GZ8MTXP02GHVNP.19.5.A05.1.454.CMB.2.raw
  modified_base (552)..(552): a, c, t, g, unknown or other
  misc_feature (552)..(552): n is a, c, g, or t
tcagtactctcgtgcacgaccggtgctcgatttagatagatagacaggcagggggcagcaagatggtgttgcagacccaggtcttcatttctctgttgctctggatctctggtgccttcggggacatcgtgctgacccagtctccagacacactggctgtgtctcgtgggcgagagggccacatcaactgcaggtccagcgagtagttattttgaacacgaacccaacagtaaacgaactacttggcttggtatcagacaagaaaccaggacagcctacctaaactgctactatttagtgggactaacgtccgtaaaccggggtaaagttcgggggtccctcgtccgtattcgacggcggcacggcgtgtcgtgggacagtattcactctacctaccatcgaacgcgacgccgtgaccgtaggcctaggaagagttggttcggggtcggttactacgttacctgtaccaaaacttaaattacttaaggtaacgtaaacgttccgtacggggttaccgtttaccggcccgtaagggtacgtaaagggtcgganacgtacgaacgtaacgacgtgtcgggctcgacactattcgtcttcttactacc

SEQ ID NO: 302905 - DNA, 602 bp, Homo sapiens
  misc_feature: GZ8MTXP02GMERM.19.5.A05.1.454.CMB.2.raw
  modified_base (223)..(223): a, c, t, g, unknown or other
  misc_feature (223)..(223): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccacatcaactgcaggtccagcgagtagtatttgacagacccaanagtaagatctgcttgatcgagacgaacagacacgcctactaactgctactatttagtgggactagtaccgtaaccggtaagttcgggtcctagtccgtattcgagcggcacggtcgtgtcgtaggacagtactttcnctccacaccatcacgcgacgtcccngccgaggctaggaaagtgttggtcgggtcgttaattacttactacgtaactaaacttaattagttaacgtaacggaaacggttacccggtaacgggtaccgtttaccggaccggttaggggaacgttaagggtacggagtacgacgtaaacggaaccggtagtcggtacgtaccgtacgaacctaacgtcttctacgtttccttctacctttccccg

SEQ ID NO: 302906 - DNA, 592 bp, Homo sapiens
  misc_feature: GZ8MTXP02GMVUZ.19.5.A05.1.454.CMB.2.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (559)..(559): a, c, t, g, unknown or other
  misc_feature (559)..(559): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagacgggccacatcaactgcaggtccagcgagtagttatttgacacgacccaacagtaagaacttacgttggcttggtactcgagacaagaaaccaggacagccctactaaactgactatagtttgtcggacactaccgtaacccgggtaagttcggggtaccctggtacgtatcgagcgcacgcgtgtcgnggacagtnttcactcacacntcancacgtcctgacgacggntacgaagngtggtacggtcgttactattacgtcgtaaacaaactaattaataagtaagtaaacgtccgtaacgggttaccgtttcccgggaccgttaggggtaacgtaaggggtagaacgtacgtacgaacggaacgtaaccgtggtacggtacncgtaccacttacgtcttacgttacttctacccg

SEQ ID NO: 302907 - DNA, 625 bp, Homo sapiens
  misc_feature: GZ8MTXP02G3138.19.5.A05.1.454.CMB.2.raw
  modified_base (225)..(225): a, c, t, g, unknown or other
  misc_feature (225)..(225): n is a, c, g, or t
  modified_base (442)..(442): a, c, t, g, unknown or other
  misc_feature (442)..(442): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtgggcgaggagggccaccatcaactgcaggtccagcgagtagttatttgacacgacccaanagtaagaacttacgttggcttggtatcgagcaagaaaccaggacacgccctacctaaatgactctatttagtggactactaccggtaaccggtaaagtttcggggtccccttaggtccgtagttcgacggcgggacacggtcgtggtacgtaggggactacggtactttccaccttctaccgaaccattacgagacctacgcccttaggcacgggtntaggaaagtcgtggttcgggacgttactagttacgtataaccaattaaagtattaagacgtaaacgtcgtacgggttactttccggaccggtaaggtacgtaagggtgtaaacgtcgtacgaaaggaccggtaagtcggtacgtgaaccgtactaaacgtcgtcgttacttccttactacccg

SEQ ID NO: 302908 - DNA, 597 bp, Homo sapiens
  misc_feature: GZ8MTXP02GI0O9.19.5.A05.1.454.CMB.2.raw
  modified_base (435)..(435): a, c, t, g, unknown or other
  misc_feature (435)..(435): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggtatcagcaagaaaccaggacacgacctacctaaactgctactatttagttgggctacgtccgtaaccccggggtaaagtttcgggggtccccttggtacccggtaatttccgaaggccggcacggccggttgtccgtaggggactaggtactttccactctaccaccatcagcacgcctgcaggctagaaagngtggtggccgttctaagttactagtaacaaactaagttattaagtagtaaaacgtcgtaacgggtacctttccggaccgtagggtaacgtaagggtcgaagctacgaaacgacgtaacgtggtcggtctaagaccaccgtattccgtcgttacttactaccg

SEQ ID NO: 302909 - DNA, 571 bp, Homo sapiens
  misc_feature: GZ8MTXP02HFFU0.19.5.A05.1.454.CMB.2.raw
  modified_base (387)..(387): a, c, t, g, unknown or other
  misc_feature (387)..(387): n is a, c, g, or t
  modified_base (456)..(456): a, c, t, g, unknown or other
  misc_feature (456)..(456): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgaccccagtctccagacacactggctgtgtctctgggcgagagggccaccatcaactgcaggtccagcgagagtattttgacagacccaacagtaagaactactggcttggatcagcagaaaaccaggacagcctacctaaactgacttcaattttattggctagtacctaacccggggtaaaagtttcggggtacccccttggtacccgatttccgagcggcacgcgtgtctgggacagtattcactctcaccntcagcacgccctgctaggctagaagtagtggtaggcggtactattactagtacaaaacgtataatttanaagtaaaacgtcccgagggttacctttcggacccgtagggaactaagggtacggagtactcaacgtaacgacgtggtaggcctgacgaacctactcgttacgtcctttacgtccc

SEQ ID NO: 302910 - DNA, 628 bp, Homo sapiens
  misc_feature: GZ8MTXP02FJ0HY.19.5.A05.1.454.CMB.2.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagtactctcgtgcacgaccggtgctcgatttagatagatagacaggcagggacagcaagatggtgttgcagacccaggtcttcatttctctgttgctctggatctctggtgccttcggggacatcgtgctgacccagtctccagacacactggctgtgtctcgtgggcgagagggcccaccatcaactgcaggtccagcgagtagttattttgaacacgaacccaaacaagtaaagaacttacgttggtcttggtatcagacaagaaaccaggacacgacctacctaaactgctntattgtggacactccgtaacccgggtaagttcggggtccctgtccgtattcgacggcgtnacggtcgtgtcgtggactagtactttcactctacacctactcgacgccacgtcctcgaccgaggacttagaagtagtcggtaggttccggttacttaacgttactacgttaacaaactaaattacttaaagtaacgtaaaccggttaccggtaacgggttaccggtttcccggggacccgtagggggtaaacgtaaaggggttcggaacgtacgtacgaaacgtacggtagtcggtagcgtaagactaccgttctaccgttctctactccg

SEQ ID NO: 302911 - DNA, 594 bp, Homo sapiens
  misc_feature: GZ8MTXP01AG40X.9.71.G05.1.454.CMB.2.raw
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (529)..(529): a, c, t, g, unknown or other
  misc_feature (529)..(529): n is a, c, g, or t
tcagtgatacgtctcacgaccggtgctcgatttagtgtcgtcgcaagagagagggggtcgacaagaggcagcgctctcgggacgtctccaccatggcctgggctctgctgctcctcaccctcctcactcaggacacagggtcctgggccctgtctgccctgactcagcccgctccgtcgtctcggtcgtcctcggacgagtcgatcaccatctcctcgcactcggacccaccactgatattgggcgattataaccttcgtctcctggtatcaacaacgcccacaacaaacgacccccaccactcttaatttaatgaggtacactaagcggccctcctagggtttcgtcgtcgcttctcctacgctcccaagtcgtcgcaacacgccctcctacganaatctctgggctccacgntgacgaccgaggctgtattattacgtgcgaggactctataattgccgtagtttcggttttccctccttttagaaanaaacggtnttttccggggccggggaacggggtaaacccnggtccgtcgttacccgttccgttggtaagtccaacggaccccgacggttcctcccgcccccgtcg

SEQ ID NO: 302912 - DNA, 504 bp, Homo sapiens
  misc_feature: GZ8MTXP01CZ998.9.71.G05.1.454.CMB.2.raw
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgatattgggcattataaaccttgtctcctggtatcaacaacgcccagacaaagccccacactctaatttatgagtcactaagcggccctcaggggtttctggtcgcttcctctgcctcaagtctggcaacacggcctccctgacaatctctggctccagtctgacgacgagctgattattactgcagctcatatgcagttgtcctntttcaagntaattcggcggaggccctaggcttggaccttccgaagtcaagcccaaggctcgccccgtcgg

SEQ ID NO: 302913 - DNA, 515 bp, Homo sapiens
  misc_feature: GZ8MTXP01EZ7F0.9.71.G05.1.454.CMB.2.raw
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccaccactgatattgggcattataaccttgtctcctggtatcaacaacgccagacaaacgccccacactcttaatttatgaggtcactaagcggccctcgagggtttctggtcgcttcctctgcctcaagtctgcaacacgcctcctgacatctctgggctcagtctgacgacgagctgattattactgcagctcatatgctagtttggttcctctttacaagtataattcgggcgggagggacccgagggcttaggaccgttcctgagtcagcccaaggtccttcgtcccccg

SEQ ID NO: 302914 - DNA, 512 bp, Homo sapiens
  misc_feature: GZ8MTXP01A6JYA.9.71.G05.1.454.CMB.2.raw
  modified_base (442)..(442): a, c, t, g, unknown or other
  misc_feature (442)..(442): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccacactcttaatttatgaggtcactaagcgccctcaggggtttctggtcgcttcctctgcctccaagtctggcaacacggcctccctgacaatctctggctccagtctgacgacgaggctgattatactgcagctcatatgctagttcgtcctntttcaagtctaattcgggcggtaggcccgaggcttcgccgttcctgagtcagcccaggccttcgcccccg

SEQ ID NO: 302915 - DNA, 539 bp, Homo sapiens
  misc_feature: GZ8MTXP01AZUI2.9.71.G05.1.454.CMB.2.raw
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgagtcactaagcgccctcgagggtttctggtcgcttcctctgcctccagtctggcaacacggcctccctgacatctntggctcagtctgacgacgaggctgattatactgcagctcatatgctagtttcggttccttntttcaaagtattaagttcggggcggtacgggaccgaagggtcttcggcccgttccgtggacgttccgacgaccccgaagggtcccttccgtccccccg

SEQ ID NO: 302916 - DNA, 529 bp, Homo sapiens
  misc_feature: GZ8MTXP01BC07X.9.71.G05.1.454.CMB.2.raw
  modified_base (404)..(404): a, c, t, g, unknown or other
  misc_feature (404)..(404): n is a, c, g, or t
  modified_base (456)..(456): a, c, t, g, unknown or other
  misc_feature (456)..(456): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccacactcttaatttatgagtcactaagcgccctcgagggtttctggtcgcttcctctgcctccaagtctggcaacacggccctcctgacaatctctgggctccagtctgacgacgnggctgattattactgacagctcatatgctagtttcgttctctttacaaagtntaagtttcgggacggtagggacccagggtcttggccgttctgacgtcgacgcccaaggtccttccgtcccccg

SEQ ID NO: 302917 - DNA, 515 bp, Homo sapiens
  misc_feature: GZ8MTXP01ENYWC.9.71.G05.1.454.CMB.2.raw
  modified_base (390)..(390): a, c, t, g, unknown or other
  misc_feature (390)..(390): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaagccccacactctaattatgaggtcactaagcggccctcagggtttctggtcgtttctctgcctcaagtctggcaacacgcccctcctgacaatctctgggctcagtctgacgacgagctgattatactgcagctnatatgctagttcgttcctcgtttacaagtattagttcggcggaggaccaggctgaccgtctggaatcagcccaaggctcgcccccgttggttccaactctcgttccccaccttcctcaagtaacc

SEQ ID NO: 302918 - DNA, 510 bp, Homo sapiens
  misc_feature: GZ8MTXP01DOVVP.9.71.G05.1.454.CMB.2.raw
  modified_base (339)..(339): a, c, t, g, unknown or other
  misc_feature (339)..(339): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctacgtgtctgggtctcctggacagtcgatcaccatctctgcactggacccacactgatattgggcattataaccttgtctcctggtatcaacaacgccagacaaacgccccacactcttaatttatgagtcactaagcgccctcgagggtttctggtcgcttcnctgcctcaagtctgcaacacggcctccctgacaatctctggctccagtctgacgacgagctgattatactgcagctcatatgctagtttggtcccttntttcaagtntaagttcggcggagggaccaggcttgaccgttcctgactcacgcccgaggtccttcgtcccccg

SEQ ID NO: 302919 - DNA, 539 bp, Homo sapiens
  misc_feature: GZ8MTXP01EMME0.9.71.G05.1.454.CMB.2.raw
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctgatcaacaacgccagacaaacgccccacactcttaattatgaggtcactaagccgcctcgagggtttctggtcgcttcctctgcctcaagtctgcaacacgccctcctgacaatctctggctccagtctgacgacgagctgattatactgcagctcatatgctagtttcgttcctntttacgaagtnttaagttcgggacggacggggttacccagggtccttacggttacccgttccgttggacgtcgaacgccccaagggtcccttccgtccccccg

SEQ ID NO: 302920 - DNA, 519 bp, Homo sapiens
  misc_feature: GZ8MTXP01D13AW.9.71.G05.1.454.CMB.2.raw
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactggacccacactgatattgggcattataaccttgtctcctggtatcaacaacgcccagacaaagcccccacactcttaatttatgaggtcactaagcggccctcagggtttctggtcgcttcctctgcctccaagtctggcacacggcctccctgacatctctggctcagtctgacgacgagctgattatactgcagctcatatgctagttggttcctntttacaagtntaatttcggcggagggttccagggtcttggacccgttccgtgacgtcgacgcccgacggtccgttccgtccccg

SEQ ID NO: 302921 - DNA, 553 bp, Homo sapiens
  misc_feature: GZ8MTXP01DQIM0.9.71.G05.1.454.CMB.2.raw
  modified_base (260)..(260): a, c, t, g, unknown or other
  misc_feature (260)..(260): n is a, c, g, or t
  modified_base (397)..(397): a, c, t, g, unknown or other
  misc_feature (397)..(397): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctctgtatcaacaacgccagacaaagccccanactctaattatgaggtcactaagcgccctcgtagggtttctggtcgcttctctgcctcaagtctggcaactaccggcctcctgacaatctctgggctccagtctgacgacgagctgattatactgacagctcaattntcgtctagtttcgtttccttactttacgaagtagtacggtcggacggaacggaccgaggtctacgaccgtctaagacgttcgaccgaccgtacggtccttcccgttccccgttcgtcctccttccgttccttccccacccttccgttaacgtaacg

SEQ ID NO: 302922 - DNA, 535 bp, Homo sapiens
  misc_feature: GZ8MTXP01D1Z0Y.9.71.G05.1.454.CMB.2.raw
  modified_base (287)..(287): a, c, t, g, unknown or other
  misc_feature (287)..(287): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagccccanactctaatttatgagtcactaagcggcctcagggtttctggtcgcttctctgcctcaagtctggcaacacgcctcctgacatctctggctccagtctgacgacgaggctgattattactgcagctcatatgctagttcggttcctcttttcaaaggtntaacgtttcgggcgggacggggaccctagggtccttaggacccgttcccgtgaacgtcgacggccccaaagggtccttcggtcccccccg

SEQ ID NO: 302923 - DNA, 562 bp, Homo sapiens
  misc_feature: GZ8MTXP01DONJ3.9.71.G05.1.454.CMB.2.raw
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctgtatcaacaacgcccagacaaacgcccccacactcttaatttatgaggtcactaagcgccctcgagggtttctggtcgcttctctgccctccaagttctggcaaccaccggcctcctgacaatcctctgggctccagtcctgacgacgagctagatttatactgcagctcatatgctagtttcggttccttcttttcaatgtaacgttcgttcgggcggtaacggccgtagtccgtcgtaccgttcgtaggacgtacgaccgaccggaacgttccgttcccgttcccgtcccgtactcccttcgtccccttaccctcccttcgtaaccg

SEQ ID NO: 302924 - DNA, 524 bp, Homo sapiens
  misc_feature: GZ8MTXP01CLKFJ.9.71.G05.1.454.CMB.2.raw
  modified_base (288)..(288): a, c, t, g, unknown or other
  misc_feature (288)..(288): n is a, c, g, or t
  modified_base (451)..(451): a, c, t, g, unknown or other
  misc_feature (451)..(451): n is a, c, g, or t
  modified_base (494)..(494): a, c, t, g, unknown or other
  misc_feature (494)..(494): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattgggcattataaccttgtctcctgatcaacaacgcccagacaaacgcccccanactcttaatttatgaggtcactaagccggccctcgaggggtttctggtcgcttcctctgcctccaagtctggcaacacggcctcctgacatctctggctcagtctgacgacgaggctgattatactgcagctcatatgctagtttcgttcctctttacaagtntaagttcgggcggtacgggaccgagggcttcgaccgttcgtgnggtccacgcccaaggtccgttcgtcccccg

SEQ ID NO: 302925 - DNA, 532 bp, Homo sapiens
  misc_feature: GZ8MTXP01C5IVB.9.71.G05.1.454.CMB.2.raw
  modified_base (338)..(338): a, c, t, g, unknown or other
  misc_feature (338)..(338): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggatcaacaacgcccagacaaagccccacactcttaattatgagtcactaagcggccctcagggtttctggtcgcttccnctgcctcaagtctggcaacacggcctccctgacaatctctgggctccagtctgacgacgaggctgattattactgcagctcatatgcagttcgttcctcttttacaagtattaagttcgggcgggtacgggaccgaagggcttggacccgttccttggaacgtcgaacgcccaacgggtccttcgtcccccccg

SEQ ID NO: 302926 - DNA, 551 bp, Homo sapiens
  misc_feature: GZ8MTXP01AXKM4.9.71.G05.1.454.CMB.2.raw
  modified_base (262)..(262): a, c, t, g, unknown or other
  misc_feature (262)..(262): n is a, c, g, or t
tcagtgatacgtctcacgaccggtgctcgatttagtgtcgtcgcaagagagaggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatattggcattataaccttgtctctgtatcaacacgccagacaaacgccccacactcttaattangaggtcactaagcggccctcgagggtttctggtcgcttctctcgcctccaagtctggcaacacgcctcctgaccatctcgtggctcagtctgacgacgaggctgattatactgctgctcatatgcagtagtggtacgacctaccgttcccggggttggtaacgttcgggacgggtacggacccgaaggtcgaccgtcgtaggtcacgcccgaaggtccgttccgcccccgttggtcccacgttccgttccgttccccgccctccgtcacggtacttactcgaacgtcgg

SEQ ID NO: 302927 - DNA, 550 bp, Homo sapiens
  misc_feature: GZ8MTXP01DS098.9.71.G05.1.454.CMB.2.raw
  modified_base (303)..(303): a, c, t, g, unknown or other
  misc_feature (303)..(303): n is a, c, g, or t
  modified_base (414)..(414): a, c, t, g, unknown or other
  misc_feature (414)..(414): n is a, c, g, or t
  modified_base (457)..(457): a, c, t, g, unknown or other
  misc_feature (457)..(457): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgccccacactcttaatttangaggtcactaagcggccctcagggtttctggtcgcttcctctgcctcaagtctgcacacggcctcctgacaatctctgggctccagtctagacgagaggctgattattacngcagctacattatgctagtttcggttccttcgtttacaaagtnttaacgttcgggacgggtagggacccgtaagggtccttcggacccgttcccgtgaacgtcacggccccgaaagggtcccttcggtcccccccg

SEQ ID NO: 302928 - DNA, 514 bp, Homo sapiens
  misc_feature: GZ8MTXP01DJKCK.9.71.G05.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctctgatcaacaacgccagacaaacgccccanactcttaatttangaggtcactaagcggccctcgaggggtttctggtcgcttccnctgcctccaagtctggcaacacggccctccctgacaatctctgggctcagtctgacgacgaggctgattattactgcagcttcatatgctagttcgttcctnttacaagtataagttcgggnggtaggccaggcttcgccgttcctgacgtcagcccagtccgttcgtcccccg

SEQ ID NO: 302929 - DNA, 503 bp, Homo sapiens
  misc_feature: GZ8MTXP01DN815.9.71.G05.1.454.CMB.2.raw
  modified_base (325)..(325): a, c, t, g, unknown or other
  misc_feature (325)..(325): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagagggggggtcacaagaggcagcgctctcgggacgtctccaccatggcctggactctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgatcaacaacgccagacaaacgccccacactcttaattatgagtcactaagcgccctcagggtttcnggtcgcttctctgcctcaagtctggcaacacggcctcctgacatctctggctccagtctgacgacgaggctgattatactgcagctcatatgctagtttcgttcctctttacaagtntaagttcgggcggaggaccgaggcttcgccgttcctgagtcagcccaggccttcgcccccg

SEQ ID NO: 302930 - DNA, 548 bp, Homo sapiens
  misc_feature: GZ8MTXP01D4JH7.9.71.G05.1.454.CMB.2.raw
  modified_base (285)..(285): a, c, t, g, unknown or other
  misc_feature (285)..(285): n is a, c, g, or t
  modified_base (447)..(447): a, c, t, g, unknown or other
  misc_feature (447)..(447): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattgggcattataaccttgtctcctggatcaacaacgcccagacaaagcccccanactcttaatttatgaggtcactaagcggccctcagggtttctggtcgcttcctctgcctccaagtctggcaacacggcctccctgacaatctctggctcagtctgacgcgaggctgattattactgcagtctcatatgctagttcggttcctctttcaagtntaagtttcggacggtacgggacccgtaaggccttgacccggttcccgtggtaacggttccgaacggccccgttaaacggggtcccttccggtcccccccgg

SEQ ID NO: 302931 - DNA, 518 bp, Homo sapiens
  misc_feature: GZ8MTXP01B0FBM.9.71.G05.1.454.CMB.2.raw
  modified_base (288)..(288): a, c, t, g, unknown or other
  misc_feature (288)..(288): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctctgatcaacaacgcccagacaaacgcccccanactcttaattatgagtcactaagcgccctcgtaggggtttctggtcgtcttcctctgccctccaagtctggcaacaccggcctccctgacaatctctggctcagtctgacgacgaggctgattattactgcagcttcatatgctagtttcggttcctntttcaagtntaagttcggcggagggaccgaggcttgccgttcctgagtcacgcccaaggtccgcgtcccccg

SEQ ID NO: 302932 - DNA, 514 bp, Homo sapiens
  misc_feature: GZ8MTXP01AFJHA.9.71.G05.1.454.CMB.2.raw
  modified_base (264)..(264): a, c, t, g, unknown or other
  misc_feature (264)..(264): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
tcagtgatacgtctcacgaccggtgctcgatttagtgtcgtcgcaagagagaggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctggtatcaacaacgcccagacaaagccccacactcttaattangaggtcactaagcggccctgagggtttctggtcgcttctctgcctccaagtctggcaacacggcctccctgaccaatctctgggctccagtctgacgacgagctgattatactgcagctcatatgctagtttggttcctntttacaagatagttcgggcgacgggaccnggctgaccgtctgagtcagcccaaggcctcgccccgtggtcacgttccttcgtccccgcctcgtcagcgtaattcgaaccg

SEQ ID NO: 302933 - DNA, 515 bp, Homo sapiens
  misc_feature: GZ8MTXP01C2U7J.9.71.G05.1.454.CMB.2.raw
  modified_base (294)..(294): a, c, t, g, unknown or other
  misc_feature (294)..(294): n is a, c, g, or t
  modified_base (417)..(417): a, c, t, g, unknown or other
  misc_feature (417)..(417): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattatactgtctctgatcaacacgccagacaaacgccccacactcttaatttangagtcactaagcgccctcagggtttctggtcgcttcctctgcctccaagtctggcaacacggcctccctgacaatctctgggctcagtctagacgacgaggctgattatactgcagctcatangctagtttcgttcctctttcaagtctaagttcggcggagggttccagggcttcggcccgttcctggacgtcgacgccaacgggtccttcggtcccccg

SEQ ID NO: 302934 - DNA, 552 bp, Homo sapiens
  misc_feature: GZ8MTXP01EV660.9.71.G05.1.454.CMB.2.raw
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggatcaacaacgcccagacaaagcccccacactcttaatttatagaggtcactaagcggccctcgaggggtttctggtcgtcttcctctgcctccaagtctggcaacacggccctccctgacaatctctgggctccagtctgacgacgaggctgattatactgctagcttcattatgactagtttcggttcccttnttttacaagtnttaagtttccgggcggtacgggacccaggggtcttacggacccgttcttaagggctcgaccgaccgacgtcgttccccgtccccg

SEQ ID NO: 302935 - DNA, 548 bp, Homo sapiens
  misc_feature: GZ8MTXP01B7C3D.9.71.G05.1.454.CMB.2.raw
  modified_base (268)..(268): a, c, t, g, unknown or other
  misc_feature (268)..(268): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctggatcaacaacncccagacaaacgccccacactcttaatttatgagtcactaagccgccctcgagggtttctggtcgcttctctgcctcaagtctgcaacacgcctcctgacatctctggctcagtctgacgacgaggctagattatactgctagctacatatgactggtttcgttcccttctttacgaaagtagttaacgttcggggacgggacgggaccgaagggtcttacggacccgttcgttaagacgttccaacgggaccccaacgggtcccttcccggtccccccg

SEQ ID NO: 302936 - DNA, 686 bp, Homo sapiens
  misc_feature: GZ8MTXP01DCBKY.9.71.G05.1.454.CMB.2.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagtgatacgtctcacgaccggtgctcgatttagtgtcgtcgcaagagagaggggggggtcacaagaggcagcgctctcgggacgtctccaccatggcctggactctgctgctcctcaccctcctcactcaggacacagggtcctgggccctgtctgccctgactcagcctgcctccgtgtctgggtctcctggacagtcgatcacatctctgcactgacccacactgatatggctattataaccttgtctcctgatcaacacgccagacaaacgccccanactacttattangagtcactaagcggcctcgtagggtttctggtcgtcttcctctcgccctaccaacgtcttcgggccaaaccgaaccgggtccctaccccgtacgaacctaaactccctcgtcggggccttcccgaaggttccgtacggaaccggaaccggagggtcctaggtaactttaattacgttcggcctaacggtccttactaattacgtcgtccgttaaggttttccggtttaccctttacttttaccgtaaaagttacgtttaaacggtttccgggggttacggggtaaacggggaccgtaaacggggtccttacgggttacccggttcccgtaagggtaaacgttccgaaccgggccccgttaaaacgggtccccgttcccggttccccccccgg

SEQ ID NO: 302937 - DNA, 512 bp, Homo sapiens
  misc_feature: GZ8MTXP01CGDVW.9.71.G05.1.454.CMB.2.raw
  modified_base (264)..(264): a, c, t, g, unknown or other
  misc_feature (264)..(264): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctgtatcaacaacgccagacaaacgccccacactcttaattangaggtcactaagcggccctcgtaggggtttctggtcgctttctctcgcctccagtctgcacacgcctcctgaccatctcgtcggctccagtctgacgacgagctagtattattactgcagctcatatgctagttcgttctctttcaagtgtagttcgggcggagggaccaggctgacctctgntcngcccagctcgccccgtcgcttcgttcttccgttccccacctcctcacgctaacttcgtaacg

SEQ ID NO: 302938 - DNA, 540 bp, Homo sapiens
  misc_feature: GZ8MTXP01B7COK.9.71.G05.1.454.CMB.2.raw
  modified_base (448)..(448): a, c, t, g, unknown or other
  misc_feature (448)..(448): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgagtcactaagcggccctcgagggtttctggtcgtcttcctctgcctccaagtctgcaacacgcctcctgacatctctggctcagtctgacgacgagctgattatactgcagcttcatatgctagtttcggttcctctttcaaagtntaagttcgggacgggacggttaccgagggtccttcggttaccgttcccgtggacgtccaacggccccaagggtcccttccggtccccccccg

SEQ ID NO: 302939 - DNA, 535 bp, Homo sapiens
  misc_feature: GZ8MTXP01EMTWD.9.71.G05.1.454.CMB.2.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (497)..(497): a, c, t, g, unknown or other
  misc_feature (497)..(497): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatatgggcattataaccttgtctcctggtatcaacaacgccagacaaacgccccacactctaatttangagtcactaagccgcctgagggtttctggtcgctttccnctgcctcaagtctggcaacacgcctcctgacatctctggctccagtctgaacgacgagctagattatacngacagtctanatatgtcctagtttcgttccttntttacaagtnttaagttcgggacgggacgggttaccagggtccttgacccgttccnggacgtccgacggacccagggtcccttccgtccccccg

SEQ ID NO: 302940 - DNA, 600 bp, Homo sapiens
  misc_feature: GZ8MTXP01D4KHG.9.71.G05.1.454.CMB.2.raw
  modified_base (282)..(282): a, c, t, g, unknown or other
  misc_feature (282)..(282): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatagtggctattataacttgtctctgatcaacacgccagacaacgccccanactacttaattatgagtcaactaagccgcctgtagggtttctggtcgtcttcctctcgcctcaagtctgcaacgacggccctcctagactatctcgtggctccgagtctagaacgacgtaggtctagtactttacgttactcggactagtccttactaaattgtcgtcgtttacggttttaccggtttcccttacgtttacgaaaggttagtaacggtttcggggacggggaacggaccgtagggtccgttaccggttccgttccgtaaggaccgtaacgacccggtaccgaacggtcccgttccggtcccccccggg

SEQ ID NO: 302941 - DNA, 549 bp, Homo sapiens
  misc_feature: GZ8MTXP01CFU6O.9.71.G05.1.454.CMB.2.raw
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggatcaacaacgcccagacaaacgcccccacactcttaatttatgaggtcactaagcggccctcgagggggtttctggtcgctttcctctgccctccaagtctggcaacacggccctcccngacaatctctgggctcagtctgacgacgaggctgattattactgcagctcatatgctagttcgttcctctttcaagtntaacgttcgggcgggagggttaccgagggtcttacggttaccgttccgttgacgtccacggaccccgaaggtcccgttcggtccccccgg

SEQ ID NO: 302942 - DNA, 662 bp, Homo sapiens
  misc_feature: GZ8MTXP01AVVEK.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccccacactgatattgggctattactaaccttgtctctggtatcaacacgccagacaaacgccccacactacttaatttatgaggtcacgtaacgccggccctcgtagggtttctcggtcgcttcctctcgcctccaacgtctcggcaacgaccggcctcccctagaacaacttcctcgttcgggccttccgaagttccgtaggaaccgacggtaagggtcctaggtaactttaacttacgtcggactaacgtcctacctaattacgtgtcgtacggtttcggtttcccttaccttttaccaaaaggttacgtttaaacgtttcccggggacgggggtaacgggacccgaaacgggggtccttccgggaccccggttcccgttaaggacggtttcccgaacggtaccccgaacgggtcccgttcccgtcccccccggg

SEQ ID NO: 302943 - DNA, 558 bp, Homo sapiens
  misc_feature: GZ8MTXP01B4LKH.9.71.G05.1.454.CMB.2.raw
  modified_base (458)..(458): a, c, t, g, unknown or other
  misc_feature (458)..(458): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgagtcactaagccgccctcgtagggtttctggtcgcttcctctgcctccaagtctggcaacacggcctccctgacatctcgtggcctcagtctgacgacgagctgattattactgacagtctcatatgctaggtttcggttccttgtttacaaagtnttaagttcgggcgggtacgggacccgaagggtccttacggacccgttcccgttggacgtccgaccggccccgaaacgggtcccgttccggtccccccccg

SEQ ID NO: 302944 - DNA, 568 bp, Homo sapiens
  misc_feature: GZ8MTXP01DF7G0.9.71.G05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctctgcactcggacccacactgtatagttgggctattataaccttgtctcctgatcaacacgccagacaaacgccccanactcttaatttangaggtcactaagccgtcctcgtagggtttctggtcgcttcctctcgcctccagtctgcaacgccgcctcccngacatctctggcctcngtctgacgacgagctgtattatactgcacgctcatatgcgtagttcgttccttntttacaagttattaacgttcgggacgggtaacgggacccgtaagggtccgttacggttacccgttcccgttgggtaacgttccggaccgtaccccggaagggtcccgttcccggttcccccccgg

SEQ ID NO: 302945 - DNA, 537 bp, Homo sapiens
  misc_feature: GZ8MTXP01C9NC3.9.71.G05.1.454.CMB.2.raw
  modified_base (404)..(404): a, c, t, g, unknown or other
  misc_feature (404)..(404): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgccccacactcttaatttatgaggtcactaagccgtccctcgtaggggtttctggtcgcttcctctgcctccaagtcctgcaacacgcctcctgacatctctggctccagtctgacgacgnggctgattactactgcacgctcagtatgctagttcgttcctntttacaagtntaagttcgggnggtacgggccaggtcttcggacccgttcctaaggtacgtccacggcccgacggtccgttccgtccccccg

SEQ ID NO: 302946 - DNA, 523 bp, Homo sapiens
  misc_feature: GZ8MTXP01D0BDC.9.71.G05.1.454.CMB.2.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataaccttgtctcctgatcaacaacgccagacaaacgccccacactcttaattatgaggtcactaagcgccctgagggtttctggtcgcttcnctgcctcagtctgcacncgcctccngacatctcgtggctcagtcagacgacgngctgatattacngacatctanatngtnttgttcgttcttnttacaagtntaaggtcgggacggacggacgtaggtcgttcggttccgttcgtaagacgtccgacgaccgttacggtcccgttccgtccccg

SEQ ID NO: 302947 - DNA, 589 bp, Homo sapiens
  misc_feature: GZ8MTXP01EFDY2.9.71.G05.1.454.CMB.2.raw
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (487)..(487): a, c, t, g, unknown or other
  misc_feature (487)..(487): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcttcaccctcctcactcaggacacagggtcctgggccctgtctgccctgactcagcctgcctccgtgtctgggtctcctggacagtcgatcaccatctcctgcactggacccaccactgatattggctattataaccttgtctcctgtatcaacaacgacccagaccaaacgcccccacactacttaatttatgaggtacactaagcggccctcgtagggtttctcggtcgtcgttcctctgcctcctaagtcctgccaacaccgggccctccctagacaatctctgggcctcgagtctaggacgacgnggtctgtaattattacnggaccagtcctnatatgctaggtttcgttccttactttacaaagtnttaagttcgggacgggaggggttacccagggtccgttacgcccggttacccgtgtacgtccgaccggaccccgttaagggtccccgttccgtccccccccgg

SEQ ID NO: 302948 - DNA, 537 bp, Homo sapiens
  misc_feature: GZ8MTXP01ACRZK.9.71.G05.1.454.CMB.2.raw
  modified_base (227)..(227): a, c, t, g, unknown or other
  misc_feature (227)..(227): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggagttatgaccttgtctcctggtaccanagcacccaggccaaagcccccaaatcatcatttangaggtcactaagcggcctcgtaggggtttctattcccgcttctctggctaccaagtctgaccaacaccgcctcctgacactctcgtgggctcccgaggctgaggacgaggctgattagtactgctgcctanatgngcagtagtggtcacgtccgtccggttggtacggttcgggacgggtacgggacgttacggttcgaaccgtcgtaacggtcacgaccgtaacggccgtccg

SEQ ID NO: 302949 - DNA, 584 bp, Homo sapiens
  misc_feature: GZ8MTXP01BGOWM.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgccccanactcttaatttatgagtcactaagcgcctcgagggtttctggtcgcttctctgcctcagtctggcaacacggcctcctgacaatctctggctcagtctgacgacgaggctgtattattactgcagctacatatgctagtttcggttcctcgttttacaaagtgttaacgtttcggggaccggtaaacgggggacccaaacggggtccgttacggttaaccccggttccccgtaaggtacggttaacccgaacggtcccccgaaaacggggtccccttcccgggttcccccccccgg

SEQ ID NO: 302950 - DNA, 591 bp, Homo sapiens
  misc_feature: GZ8MTXP01BW2QM.9.71.G05.1.454.CMB.2.raw
  modified_base (266)..(266): a, c, t, g, unknown or other
  misc_feature (266)..(266): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatattggctattataaccttgtctcctgtatcaacacgccagaacaaacgccccacactcttaattangaggtcactaagccgccctcgtagggtttctggtcgtcttctctgcctccaagtctggccaacaccggcctcctgaccaatctcgtgggctaccagtctgacgacgaggctgattacttactgctgctcatatgcagagtggtagactaccgttccggggtaggttacgttcggggccgggaacgggaaccgtaggggtacgtacccggtcgtacgggtaccacgccccgaaggccgttacccggcccccgttcggtacctccgttccgttcccggttcccccgtcccttcccgtaacgacggtaccttcgtccaacgtaacggg

SEQ ID NO: 302951 - DNA, 566 bp, Homo sapiens
  misc_feature: GZ8MTXP01D706M.9.71.G05.1.454.CMB.2.raw
  modified_base (263)..(263): a, c, t, g, unknown or other
  misc_feature (263)..(263): n is a, c, g, or t
  modified_base (391)..(391): a, c, t, g, unknown or other
  misc_feature (391)..(391): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctctgtatcaacaacgccagacaaacgccccacactcttaattangagtcactaagcgccctcgagggtttctggtcgctttctctgcctcaagtctggcaacacggcctcctgaccaatctcgtgggctacagtctgacgacgaggctgatttatactgctgctcatatganagagtgtacgactaccgtaccgggttcggttacggttacgggacgggaacgggaacgtaacggtacgtaccgtaccgtacgtacgacgaccgaacgccgttccgtccccgttccgtctccttccgttccgttcccgtccctccctaaccgacgtacgttactaacgttcgtaacg

SEQ ID NO: 302952 - DNA, 645 bp, Homo sapiens
  misc_feature: GZ8MTXP01ACJSV.9.71.G05.1.454.CMB.2.raw
  modified_base (305)..(305): a, c, t, g, unknown or other
  misc_feature (305)..(305): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtgacagtcgatcaccatctcctgcactcggaaccccacactgattagtggactattataaccttgtctctgatacaacacgccagacaaccgccccatactacttaattangagtacacgtaagccgcctgtagggtttctcggtcgtcttcctctcgccctacacgtctcggccaacgaccggtccctcccgtgactactctcgtcgggtacctcgtagttcgagaccgacggacgtcgttagtaactttacttaccgtgacgtacgtctactacgttacgtcgtaccgtttacggttttaccgtttacccttaacgtttaacgtaaacgttacgttaacgggtcggggaccggggtaacgggttaccgtacgggtccgttaccggttcccgttacgtaacggtacgtaaccgacccggtacccgacggttccccgttccccggtccccg

SEQ ID NO: 302953 - DNA, 587 bp, Homo sapiens
  misc_feature: GZ8MTXP01CLMGR.9.71.G05.1.454.CMB.2.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (580)..(580): a, c, t, g, unknown or other
  misc_feature (580)..(580): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatagtggctattataaccttgtctctgtatcaacaacgccanacaaacnccccanactcttaattangagtcactaagcgcctgtagggttctggtcgtcttctctcgcctacaagtcgtcggacaacgaccggccctcctcgaacccactctcgtggcctaccagtctgaaccgacggagctagtatttattacngtctcgctnaatagtgacaagtagtggtanacctaccgttcccggggttaggttacgtcgggacgggaacggaaccgaagggtcaacccggtcctaagggtccaaccggcccgaaggtcccttccgcccccttgggtacctcttccgttccgttccccgtaaccctctaacgaggtacttacgtcncggtcgg

SEQ ID NO: 302954 - DNA, 522 bp, Homo sapiens
  misc_feature: GZ8MTXP01AJXHB.9.71.G05.1.454.CMB.2.raw
  modified_base (453)..(453): a, c, t, g, unknown or other
  misc_feature (453)..(453): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggatcaacaacgccagacaaacgcccccacactcttaatttatgaggtcactaagcggccctcgaggggtttctggtcgcttcctctgcctccagtctggcaacacggcctccctgacatctctgggctcagtctgacgacgaggctgattatactgcagctcatatgctaggtttcgttcctgtttacaagtntaagtcggcggacgggaccaggtcttcgacccgttcgtgacgtcacgcccgaaggtccttcgtcccccg

SEQ ID NO: 302955 - DNA, 529 bp, Homo sapiens
  misc_feature: GZ8MTXP01CW4T4.9.71.G05.1.454.CMB.2.raw
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggatcaacaacgcccagacaaacgccccacactctaatttatgagtcactaagcgccctcagggtttctggtcgcttcctctgcctcaagtctgcaacacggccctccctgactaatctctcggctccagtctacgacgacgaggctgattatactgcagctcatatgctagttcggttcctntttcaagtnttaagttcgggcggtaggacccgaggcttgcccgttcctgacgttcgacgcccgaaacgtcccgttaacgtccccccg

SEQ ID NO: 302956 - DNA, 533 bp, Homo sapiens
  misc_feature: GZ8MTXP01BHFKA.9.71.G05.1.454.CMB.2.raw
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (421)..(422): a, c, t, g, unknown or other
  misc_feature (421)..(422): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagagggggggtcacaagaggcagcgctctcgggacgtctccaccatggcctgggctctgctgctccccaccctcctcactcaggacacagggtcctgggccctgtctgccctgactcagcctgcctccgtgtctgggtctcctggacagtcgatcaccacctcctgcactggacccaccactgatattgggcattataaccttgtctcctggtatcaacaacgcccagacaaaagcccccaacactcttaaattatgagtcactaaagcggccctcaggggtttctggtcgctttctctcgcctcaagtctggacaacncggcctccctgacaatcnctgggctcagttcngacgacgaggntntatatatnnancgtctatatgctgttgttcttcttntaatatagtggcggacggacgacgcgtcgtacgttcgttcgacgtaacgacgaaccgacggacgttccgtccccgttccgtccg

SEQ ID NO: 302957 - DNA, 630 bp, Homo sapiens
  misc_feature: GZ8MTXP01DETLZ.9.71.G05.1.454.CMB.2.raw
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcggacccacactgatattggctattatactgtcnctgatcacacgccagacaacgccccanactcttaattangagtcactagcgccctgtagggtttcnggtcncttcncgtgcctaccagtctgcaaacgccggcctcctgacactctcgtggcctacgacgtcacggacgacgtacggtctagttacttagttacgtcgcggtactcttactaagttcgtcgtaccgttaggttttccggtttccctttagtttaacgaaacgttagtttaacgggccggggttacgggtaaacggggaaccccgtagggttcccgttaccggggttaacccttccggttaacggtacccggtaaccggtaacccggaccccgggttaacgggtccccttccccggggttcccccccg

SEQ ID NO: 302958 - DNA, 585 bp, Homo sapiens
  misc_feature: GZ8MTXP01D23TU.9.71.G05.1.454.CMB.2.raw
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagtgatacgtctcacgaccggtgctcgatttagtgtcgtcgcaagagagaggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataacttgtctctgtatcaacaacgccagacaaacgccccacactctaatttangagtcactaagcgccctcgagggtttctggtcgcttctctgcctcaagtctggcaacacccggcctcctgacaagtctcncgggctcagtctgacgacgagctgtattntactgcagctnatatgctagttcgttcttctttacgaaatattagttcggcgggtaaggtacctagggtccttggtaacccgtccgtaagtacgttcgaccggccccgtaaaggggtcctttccccggccccccgttacgggtcccctaaaccgttcccgtttcccgtacccccttaccccgttccccgtttaactaaaccccgg

SEQ ID NO: 302959 - DNA, 529 bp, Homo sapiens
  misc_feature: GZ8MTXP01B5BRB.9.71.G05.1.454.CMB.2.raw
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatatgggcattataaccttgtctcctgatcaacaacncccaagacaaacgcccccacactacttaatttatgacggtacactaagccggtccctcgtaggggtttctgtcgtcttctctgccctcagtcnggcaacncgccctcctgacatctctggcctcagtctgacgcgagctgtattatactgcagctacatntgctagtttcggttccttctttcaaagtnttaacgttcggacgggacggccgaggtcttggaccgttcgtgacgtcacggtccacgtcgttccgtccccg

SEQ ID NO: 302960 - DNA, 679 bp, Homo sapiens
  misc_feature: GZ8MTXP01BX3XE.9.71.G05.1.454.CMB.2.raw
  modified_base (271)..(271): a, c, t, g, unknown or other
  misc_feature (271)..(271): n is a, c, g, or t
  modified_base (644)..(644): a, c, t, g, unknown or other
  misc_feature (644)..(644): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctctgatcaacaacnccagacaaacgccccacactacttaattatgaggtacacgtaagccgccctcgtagggtttctcggtcgtcttcctctcgtccctcctaagtccgtacggccaaaccgacccgggtccctccccgttagaacctaaattcccgttcgtcggggcccttacccgtaaggttcccgttaggaaaccggtacgggtaacggtccgttaaggtactttaaactttacgtcggactaacggtccttactagttaaccttgtaccgttaaggttttccggtttcccttacttttacgaaacggtagttaacggttccgggacggggaaccggggttactaacgggcttaccggttacccgttccgtaaggtcgtaaccncggtacccgaacgggtcccttcccggtccccccgg

SEQ ID NO: 302961 - DNA, 536 bp, Homo sapiens
  misc_feature: GZ8MTXP01DS7LV.9.71.G05.1.454.CMB.2.raw
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccacactcttaatttatgaggtcactaagcggccctcgagggtttctggtcgcttctctgcctccaagtctggcaacacggcctcctgacaatctctggctcagtctgacgacgaggctgattattactgcagtctacatatgctagtttcggttccttctttacaagtnttaagttcggngggacgggttacccgagggtcttcgaccgttcctgcgtcacgcccgaacgggtccttccgtccccccg

SEQ ID NO: 302962 - DNA, 550 bp, Homo sapiens
  misc_feature: GZ8MTXP01AN4GQ.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactggacccaccactgatattgggcattataaccttgtctcctggtatcaacaacgcccagacaaacgcccccacactcttaatttatgaggtcactaagccggccctcgaggggtttctggtcgcttcctctgcctccaagtctggcacaccggcctccctgacatctctggcctcagtctgacgacgaggctgacttatactgcagctcatatgctagtttcggttccttcgtttacaagtattaagttccgggcgggacgggaccgagggtccgttcgacccggttccgtggacgtccgacggacccgaaggtccgttccgtcccccccgg

SEQ ID NO: 302963 - DNA, 517 bp, Homo sapiens
  misc_feature: GZ8MTXP01AMTTF.9.71.G05.1.454.CMB.2.raw
  modified_base (268)..(268): a, c, t, g, unknown or other
  misc_feature (268)..(268): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaattangaggtcactaagcggcccctcgaggggtttctggtcgcttctctgcctccaagtctggcaacacggcctcctgacccatctctggctccagtctgacgacgagctgattatactgcagcttanatangctgtcgttctnttanagngtgtcggcggacggacngctcgaccgtcgtgcgtcgcgccacgcctccgccccgtcgtccncgttccttccgtccccncctccgtacgacgttactccgcgtg

SEQ ID NO: 302964 - DNA, 586 bp, Homo sapiens
  misc_feature: GZ8MTXP01B866B.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctgtatcaacaacgcccagacaaacgccccacactcttaatttatgaggtcactagcggcctcgagggttctggtcgcttcctctgcctccagtctggcaacacgccctcctgacaactctcgtgggtcctccagtcgtagacggaccgagggtcctagtacttagttactgtaccagtctcattatcgcttaggtttcgttccttcgtttacaaggtattaacgttcggggacgggacgggacccgtagggtccttacggttacccgttcccgttgggaacgttccgaacggccccttaaaggggtccccttccggtcccccccgg

SEQ ID NO: 302965 - DNA, 511 bp, Homo sapiens
  misc_feature: GZ8MTXP01CCDHN.9.71.G05.1.454.CMB.2.raw
  modified_base (392)..(392): a, c, t, g, unknown or other
  misc_feature (392)..(392): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacaacgcccagacaaacgcccccacactacttaatttatgaggtcactaagccggccctcgagggtttctggtcgcttcctctgccctccagtctggcacaccgcctcctgacatctctggctcntctgacgacgagctgattatactgcagctcatatgctagtttcgtcttcttanagtntgtcggcggaggccaggtcttcgttccgttcgtgacgtcacgccgacgccgttcgtcccccg

SEQ ID NO: 302966 - DNA, 591 bp, Homo sapiens
  misc_feature: GZ8MTXP01APRDL.9.71.G05.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (411)..(411): a, c, t, g, unknown or other
  misc_feature (411)..(411): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatatggctattatacttgtctactgatcaacacnccagacaacgccccanactacttaattatgagtacactaagccggccctcgtagggtttctggtcgtcttcctctgcctccagtctcgcaacgaccggccctccctagacaatctcgtcggcctccgagtctggaacgacggngtctagtaacttataacgtgacagtcctanaattagtgcgttagtttcgttcccttacgtttacaagtcttaacggttcgggacggggacggacccgtaaggtcccttacggcccgttccgttaacggacgttcccgaaccggaccccgttaacggggtccccttccccggtccccccgg

SEQ ID NO: 302967 - DNA, 526 bp, Homo sapiens
  misc_feature: GZ8MTXP01CYK07.9.71.G05.1.454.CMB.2.raw
  modified_base (450)..(450): a, c, t, g, unknown or other
  misc_feature (450)..(450): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccaccactgatattgggctattataaccttgtctcctggtatcaacaacgccagacaacgccccacactctaatttatgaggtcactaagcggtccctcgagggtttctggtcgcttcctctgcctcaagtctggcaacacggcctcctgacatctctggcttcagtctgacgacgaggctgattagtactgctagctcatatgctagtttcgtcctcgtttcaagtntaagttcgggacggtacgggcccagggcttcggacccgttccgtgacgtcacgcccaagggtcccttcgtcccccg

SEQ ID NO: 302968 - DNA, 550 bp, Homo sapiens
  misc_feature: GZ8MTXP01B2FJ1.9.71.G05.1.454.CMB.2.raw
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (460)..(460): a, c, t, g, unknown or other
  misc_feature (460)..(460): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataacctgtctcctggatcaacaacgccagacaaagcccccacactcttaattatgagtcactaagcgccctcagggtttcnggtcgcttcctctgcctccaagtctgcaacacggcctcccngacatctctcgggctccgngtctgacgacgaggctgacttatactgcacgcttacattactgctaggtttcggtttcccttcgtttcaaaggtnttaacggtttcggacgggaaggggaccctaaggggcttacgggttaccgttcctggaacgttcacggcccaagggtccttcgtccccccg

SEQ ID NO: 302969 - DNA, 533 bp, Homo sapiens
  misc_feature: GZ8MTXP01C0U00.9.71.G05.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctcctggtatcaacacgccagaccaaacgccccacactcttaatttangagtcactaagccgccctcgtagggtttctggtcgcttcctctgcctccaagtctgcaacnccggcctccngacatctctggctccgngtctggacgacgaggctagtattattacngcagctcatntgctagtttcgtccttnttcaagtattaacgtcggacgggaggaccgtaggtcttacggccgttctgacgtcaccggcccgttacggtccgttcccgtcccccg

SEQ ID NO: 302970 - DNA, 552 bp, Homo sapiens
  misc_feature: GZ8MTXP01DRBNQ.9.71.G05.1.454.CMB.2.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatatggntattataaccttgtctctgtatcaacaacnccagacaaacgccccacactacttaattangagtcacgtaagccgcctgtagggttctggtctcttctctcgcctacctaagtctcggacaacgaccgtcctacctcgacctactctcgtcggcctaccagtcgagacgacggagntagtattacttctgtctgctcatatgcagagtggtacacgtacgtccggggtgttacgtcgggacggaggaccgaggtcgtaccgtcgtagcgacgccgaagccttccgccccgttgtaccncttccgttcccgttccccgccctacgtcacgtacttactcgaagtcggg

SEQ ID NO: 302971 - DNA, 565 bp, Homo sapiens
  misc_feature: GZ8MTXP01EJC88.9.71.G05.1.454.CMB.2.raw
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (461)..(461): a, c, t, g, unknown or other
  misc_feature (461)..(461): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattggctattataactgtctctgatcacacgccagacaacgccccacactcttattatgagtacactagccgccctcgtagggtttctggtcgtcttccctctcgccctacctaagtccttcggcaaccgaccggtccctccctacgacaactcctcgtggcctcngtctagacgcgagctagattntacngcacgtctacatatcggaccttagtttcgttaccttnttacgaagtgtaacgttcgggacgggtacgggcgtaggtccgttacggttacccgttccgaagtacgtccgacggtcccgaaggtcccgttaacccgtcccccg

SEQ ID NO: 302972 - DNA, 556 bp, Homo sapiens
  misc_feature: GZ8MTXP01EKO0O.9.71.G05.1.454.CMB.2.raw
  modified_base (423)..(423): a, c, t, g, unknown or other
  misc_feature (423)..(423): n is a, c, g, or t
  modified_base (508)..(508): a, c, t, g, unknown or other
  misc_feature (508)..(508): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggctattataacttgtctctgatcaacacgccagacaaacgccccacactacttaattatgaggtcactaacgccgcctcgtagggtttctcggtcgtcttcctctcgcctcaagtctgcacaccgcctcctagactactctacgtcggtctcgagtctcggacgacgacggctagtattacttacngacagtctactaatagtcgcgttacggtttcgtttcccttcgttttacaaaggtacttaacggttcggacgggacgggttaccgngggtcttacggccgttctgacgtcacggcccaggtccttccgtccccg

SEQ ID NO: 302973 - DNA, 563 bp, Homo sapiens
  misc_feature: GZ8MTXP01AYJFB.9.71.G05.1.454.CMB.2.raw
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctgtatcaacaacgcccagacaaacgcccccacactcttaattatgaggtcactaacgcggcccctcgaggggtttctggtcgtcttctctgcctccaagtctggcaacaccggcctcctgacatctctcgggctccagtctgacgacgaggctgtattatactgcagctacatatgctagtttcggttccttcgtttacaagtattacgttccggacgggtagggaccgaggtccgtcgtaacccgtcgtgacgttcgacgcccgaaaggcccttacggccccttcggtcctaccgttccttccggttccccgcccttccgttcgtaaccg

SEQ ID NO: 302974 - DNA, 573 bp, Homo sapiens
  misc_feature: GZ8MTXP01DPLYF.9.71.G05.1.454.CMB.2.raw
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcacatctctgcactcgacccacactgatnttggctattatactgtctctgatcaacacgccanacaacgccccanactcttaattangagtcactaagcgtcctgtaggtttctggtctcttctctcgcctacagtctaggcacnccggcctcctgactatctacgtggctcagtctagacgagagctgtacttatactgctagtctactatagtcgtacgttaaggttttcgttccttagtttacgaaacgttactttaacgggttcgggaccggggtacgggaccgtaagggtccttacggttcccggttccttgggaaacgtccgaaccggaccccgttaaggtccccgttcccggttaaccccccgg

SEQ ID NO: 302975 - DNA, 575 bp, Homo sapiens
  misc_feature: GZ8MTXP01AO7CS.9.71.G05.1.454.CMB.2.raw
  modified_base (287)..(287): a, c, t, g, unknown or other
  misc_feature (287)..(287): n is a, c, g, or t
  modified_base (491)..(491): a, c, t, g, unknown or other
  misc_feature (491)..(491): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctctggatcaacacgccagacaaacgccccanactacttaatttatgaggtacactaacgcggtccctcgacgggtttctggtcgtcttccctctcgtcctccgaacgtctcggcaaaccaccgggcctccctagacactctcgtgggctcccagtcctagacgacgagggtctacggtattacttacgtgaccagctcatactgtcgtagtttcggttcctcttaccgtaaagtnttaacgttcgggagggtacgggacgtacggcttcgacccgttccgtaagaccgtcgacgcccgaacggtccgttcgtcccccgg

SEQ ID NO: 302976 - DNA, 571 bp, Homo sapiens
  misc_feature: GZ8MTXP01EKA1O.9.71.G05.1.454.CMB.2.raw
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccacactgatatggctattataaccttgtctctgtatcaacaacgccaagacaaacgccccacactctaattangagtcactaagccgacctcgtagggttctggtcgtcttctctcgcctcaagtctaggaccaacgaccgcctccctagaacccactctcgtcgggtcctcgtacgttcgngacgacgaggctagtattatactgnagctnattatcgtgtagttcggttccctgtttaacgagttagtcgttcggggacgggacgggaccgaggcgtacggtaccctgtacgtgtaccgacgaacccaagggttcctccgttaccccgtgtccttacttccgttacctcccaccctcgtacagttaccgtcttcgtaacg

SEQ ID NO: 302977 - DNA, 558 bp, Homo sapiens
  misc_feature: GZ8MTXP01CEEBG.9.71.G05.1.454.CMB.2.raw
  modified_base (274)..(274): a, c, t, g, unknown or other
  misc_feature (274)..(274): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggctattataaccttgtctctgtatcaacaacncccagaacaacgcccccacactcttaatttatgagtcactaagccggccctcgtagggtttctggtcgtcttcctctgcctcaagtctgcaacacgccctcctgacatctctggcctcgagtcngacgacgnggctgtattattctgcgagtctcagtatcgctaggtttcgttccttcttcgaaatgtaagttcgggcgggtaacggcccgtaggtccgttacggttcccgttcgtggaacgtccgaccggcccgaacggtccccgttcccgttccccccggg

SEQ ID NO: 302978 - DNA, 580 bp, Homo sapiens
  misc_feature: GZ8MTXP01EHL6Q.9.71.G05.1.454.CMB.2.raw
  modified_base (363)..(363): a, c, t, g, unknown or other
  misc_feature (363)..(363): n is a, c, g, or t
tcagtgatacgtctcacgaccggtgctcgatttagtgtcgtcgcaagagagaggggggggtcacaagaggcagcgctctcgggacgtctccaccatggcctgggctctgctgctccccaccctcctcactcaggacacagggtcctgggccctgtctgccctgactcagcctgcctccgtgtctgggtctcctggacagtcgatcaccacctcctgcactggacccaccactgatattggcattataacctgtctctgtatcaacaacgcccagaacaaacgcccccacactcttaattatgagtcactaagcggccctcgtagggtttctggtcgcttctctcgcctcaagtctggacaacncgcctcctgacatctctcgggctcagtctgacgacgagctgtattatactgactgctcattagtgctaggttcgtttccttacgttttacaaagtattaacggttcgggaacgggaaggggccgagggttaccgtggtaaccccggttcgttacggaacgttccgaaccgccccgtaaagggtcccttacccggtccccccgttcgggttaaccccg

SEQ ID NO: 302979 - DNA, 531 bp, Homo sapiens
  misc_feature: GZ8MTXP01BB4WG.9.71.G05.1.454.CMB.2.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (339)..(339): a, c, t, g, unknown or other
  misc_feature (339)..(339): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (444)..(444): a, c, t, g, unknown or other
  misc_feature (444)..(444): n is a, c, g, or t
tcagtgatacgtctcacgaccggtgctcgatttagtgtcgtcgcaagagagaggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctctgtatcaacaacgccagacaagccccanactcttaattangaggtcactaagcggccctcgaggggtttctggtcgcttctctcgcctcaagtctgcaacgaccgcctcngacaatctctcggctcgatctgacgacgagctgattatactgcagcttanatntcgcgtagttcgttcttacttacgaagtagttacgtcggacggacggaccgngtcgtcgtccgtcgtgacgttcgacgaccgacgtccttccgccccgttcgtcctccgtccgttcccgtcccgttcctccgcgtaacg

SEQ ID NO: 302980 - DNA, 575 bp, Homo sapiens
  misc_feature: GZ8MTXP01CV4RH.9.71.G05.1.454.CMB.2.raw
  modified_base (305)..(305): a, c, t, g, unknown or other
  misc_feature (305)..(305): n is a, c, g, or t
  modified_base (383)..(383): a, c, t, g, unknown or other
  misc_feature (383)..(383): n is a, c, g, or t
  modified_base (437)..(437): a, c, t, g, unknown or other
  misc_feature (437)..(437): n is a, c, g, or t
  modified_base (473)..(473): a, c, t, g, unknown or other
  misc_feature (473)..(473): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggatcaacaacgcccagaccaaacgcccccacactcttaatttangtaggtcactaagccggccctcgtaggggtttctggtcgcttcctctgcctccaagtcctgcaacaccggccctcccngacatctctggtcctcagtctgacgacgaggctgtattattactggcagtctanacttatcgtctaggtttcgttcctcttttacaagtnttaacgttccgggcgggtaacgggacccaagggtccttcggttacccgttccgtcggaacgtccgaacggccccttaagggtcccgttccggtcccccccgg

SEQ ID NO: 302981 - DNA, 537 bp, Homo sapiens
  misc_feature: GZ8MTXP01B2V4L.9.71.G05.1.454.CMB.2.raw
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattgggctattataaccttgtctcctggtatcaacaacgcccagacaaacgcccccacactcttaatttatgaggtcactaagcggccctcagggtttctggtcgcttcctctgcctccaagtctggcacacggcctccctgacatctctgggctcagtctgacgacgaggctgattatactgcagctcattancgcgtagtttcggttcctatttcaagtntaagttcgggcgggaacgggcccaggtcttcgttaccggttcctgtacgtcgaacgcccgaagggtccttcggtaaccccccg

SEQ ID NO: 302982 - DNA, 568 bp, Homo sapiens
  misc_feature: GZ8MTXP01A6FX2.9.71.G05.1.454.CMB.2.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
  modified_base (425)..(425): a, c, t, g, unknown or other
  misc_feature (425)..(425): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatatgggcattataacttgtctcctgatcaacacgccanacaacgcccccanactcttaatttatgaggtcactaagccgccctgagggtttctggtcgcttccnctcgcctcaagtctgccacacgccctcctgactatctctggctcgagtctagacgacgagctgattacgtactcgcaagctacatancgtcgtagtttcggttaccttcgttacaaagtagttaacgttacggggcgggaacgggttaccccgagggtcttaccggttacggttcccgttaaggacgttcgaccggaccccgaaacggggtcccttccgggtcccccccg

SEQ ID NO: 302983 - DNA, 568 bp, Homo sapiens
  misc_feature: GZ8MTXP01DC4JF.9.71.G05.1.454.CMB.2.raw
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (544)..(544): a, c, t, g, unknown or other
  misc_feature (544)..(544): n is a, c, g, or t
  modified_base (563)..(563): a, c, t, g, unknown or other
  misc_feature (563)..(563): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataaccttgtctctgtatcaacaacgccagacaaacgccccanactcttaattangagtcactaagcgcctgtagggttctggtcgcttcgtctgcctacaagtctggaccaacaccggtccctcctacgacccaactctcgtcgggcctacccgagtctgacgacgaggctagtattatactgcagtctactagtatcgccttagtttcgttaccttctttagaacgttagtacggttcgggacggacgggaccaggtcgtcgacccgtcgtgacgtcgaccgaaccgacgccgtacccgccccgtcggtccttaccgttccgttccggttcccccncctctacgacgttacgtcncgtcg

SEQ ID NO: 302984 - DNA, 562 bp, Homo sapiens
  misc_feature: GZ8MTXP01AT3NB.9.71.G05.1.454.CMB.2.raw
  modified_base (260)..(260): a, c, t, g, unknown or other
  misc_feature (260)..(260): n is a, c, g, or t
  modified_base (416)..(416): a, c, t, g, unknown or other
  misc_feature (416)..(416): n is a, c, g, or t
tcagtgatacgtctcacgaccggtgctcgatttagtgtcgtcgcaagagagaggggggggtcacaagaggcagcgctctcgggacgtctccaccatggcctgtgctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctccngtatcaacaacgccagacaaacgcccccacactcttaattatgaggtcactaagcggcctcgagggtttctggtcgccttctctgcctcaaagtctggcaacacggcctcctgacaatctcgtgggctcagtctgacgacgaggctgattattacngggcagtctacatatcgtctagtttcggttcccttctttacaaggtaacttacggttcgggcgggttacgggacccgaacgggttcgttcggttacccggtccttaggaacgttccgacggttaccccgaaggcccgttccccggg

SEQ ID NO: 302985 - DNA, 600 bp, Homo sapiens
  misc_feature: GZ8MTXP01C9UED.9.71.G05.1.454.CMB.2.raw
  modified_base (286)..(286): a, c, t, g, unknown or other
  misc_feature (286)..(286): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggatcaacaacgccaagacaaaacccncccactactacttaattagtagagtacacgtacgcgcctcgtaggttctgtcgtcttcctctcgtcctacaagtctacgccaacgaccgcctcctacgactaactctcgtcgcctaccgacgtacgtacgaacgacgacggtacgtagttacttaacttactacgacgtacgtactactagtatcgtcgttacgtttacgtttccttacttacgtaacgtaagttaacgttacggacgggtacggaaccgtacggtacgttacgttccgttccgtcgtacgtaacgacgtaccgaccgtccgttcccgtccccg

SEQ ID NO: 302986 - DNA, 578 bp, Homo sapiens
  misc_feature: GZ8MTXP01DPR0A.9.71.G05.1.454.CMB.2.raw
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcacatctcctgcactggaaccagcagtgattggttggagttatgaccttgtctcctggtaccaacagcacccgagaccaaacgccccaaatcatcatttangagtcactagccggcctcgtagggttctattccgcttctgtggtcctacaatctagacaacgacgtccctcctagaacatctcgtcgggctcgagtcgtaggaaggtaccggagaccgtgtaaatttacttacgtcgtactgacctanatagttcgaacgagtaagtcgggtactacgtaacccttcccgggttaggttacgttccgggacgggtacgggaaccgttaggttaccgtccggtacgtaaggtacacggaccgtaacggccgtccccgg

SEQ ID NO: 302987 - DNA, 536 bp, Homo sapiens
  misc_feature: GZ8MTXP01A8W90.9.71.G05.1.454.CMB.2.raw
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
  modified_base (463)..(463): a, c, t, g, unknown or other
  misc_feature (463)..(463): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctgtatcaacaacnccagacaaacgccccacactcttaatttangagtcactaagccggccctcgtagggtttctggtcgtcttcctctgcctcaacgtctcgcacaccgcctcctgactatctcgtggctcngtctgacgacgaggctagtattatactgcagtctcagtatcgtctagtttacgttcctcttttacaagttntaagttcgggcgggacggcgacggtcacgttcgttccgtgacgtcgacgcccgacggtccgttcccgtccccg

SEQ ID NO: 302988 - DNA, 647 bp, Homo sapiens
  misc_feature: GZ8MTXP01CKX4Y.9.71.G05.1.454.CMB.2.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (613)..(613): a, c, t, g, unknown or other
  misc_feature (613)..(613): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctacgtgtctggtctctggacagtcgatcaccatctctgcactcggacccacactgatntggctattatactgtctctgatcaacacnccagacaacgcccanactctattangagtcactaagccgtccctcgtagggtttctggtcgtcttcctctcgtcctaccaagtccgtacggcaaccgtacccggtccctcccgtagaacctaaacttcctccgtcggggcctacccgtaaggttcctacggaaccgggtacgtaacgggtccttaggttaactttaacgttaaccttgggaacctacggtacctttacgaagttactcggtacccgtttaaggttttccggttaccctttacgtttacgaaagttcgttaacggttcggggacgggtaacggccgtaagggtcttaccggcccgttacgtgacggtaacnccgggcccttaacggtccgttcccgtaaccccgg

SEQ ID NO: 302989 - DNA, 689 bp, Homo sapiens
  misc_feature: GZ8MTXP01EKS6R.9.71.G05.1.454.CMB.2.raw
  modified_base (334)..(334): a, c, t, g, unknown or other
  misc_feature (334)..(334): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattggcattataaccttgtctctgtatcaacaacgccaagacaaacgccccacactcttaattatgagtcactaagcggcctcgtagggtttctgtcgtcttctctcgcctcagtctgacaacnccgcctctgacatctgtcggctccgagtctagacgacgaggtcttgtaatttatacctgacgtaactccttacaattacgtcgtacgttaagggttttccgggtttaccctttacgtttttaaccgaaaggtttaagtttaacgggtttcccggggacggggttaacgggaaaccccgtgggtacccggttacgtaaaccccgggttcgttaaggaaccggttccgaaaccggttaccccgtaaacgggggtccccttccccgggttccccccgtttaccgggttaaccctaccccgtttcccctttcccggttacccccccttacccctttccccggttaacgtaaaccccggg

SEQ ID NO: 302990 - DNA, 732 bp, Homo sapiens
  misc_feature: GZ8MTXP01A3TR5.9.71.G05.1.454.CMB.2.raw
  modified_base (284)..(284): a, c, t, g, unknown or other
  misc_feature (284)..(284): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatatgggctattataacttgtctctgatcaacacgccagacaacgccccanactcttaattatgaggtacactaacgccgccctcgtagggtttctggtcgtcttcctctcgcctccaagtccgtcgggccaaaccgacccgggtccctaccccgtagtaacctaaacttcccgtccgtcggggtcccttccgacggttccgttacggaaccggaccggtacgggtaccgttaggttaactttaacgttaaccgttcggacctaaacggtccttaacctaacgtttaagttacggtccgtttaacgggtttttccgggttttaccccttttaccgttttaaccgtaaaggttaacgtttaaacgggtttaccgggaaaccggggtaaccggggaacccgtacggggtacccgttaccgggttaccccggttccgttaagggaccggttccgaaccggccccgttaaacgggtccccgttaaccccgggttcccccccgg

SEQ ID NO: 302991 - DNA, 632 bp, Homo sapiens
  misc_feature: GZ8MTXP01B9JL7.9.71.G05.1.454.CMB.2.raw
  modified_base (261)..(261): a, c, t, g, unknown or other
  misc_feature (261)..(261): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggctattataaccttgtctcctgtatcaacacgccagacaaacgccccanactcttaatttatgaggtcactaacgcggccctcgtagggtttctggtcgcttctctgcctcaagtctggcaacaccggccctctgaacctaatcctcgtcgggcctacccgtagtcctggacgacggaggcttagtattacttactgctaagctactatatgctagtttcgttaccggttctttacgaagttacgttaacggtttcgggacggggaacgggtaccgtacgggtccttaccggtacccggtcgtaaggtacgttccgtaaccggcccggtaaacggtccccgttccggttcccccccgttgggttaacccctcccgttcccgttacccggttcccccacccgttccccttcgtaaccccgg

SEQ ID NO: 302992 - DNA, 547 bp, Homo sapiens
  misc_feature: GZ8MTXP01AW2TR.9.71.G05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagtgatacgtctcacgaccggtgctcgatttagtgtcgtcgcaagagagagggggggtcacaagaggcagtgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacaacgcccagacaaagcccccanactcttaatttangaggtcactaagcggccctnagggtttcnggtcgcttcctctgcctcaagtctggcaacacgcctcctgacatctntggctcagtctgacgacgagctgattatactgccgagctcatatgcgtagtttcgttcctcgtttacaagattaacgttccgggaggtacgggaccgaacgggcgttccgaccgtttccgaaggtaacgttccgaacggcccttaacggggcccttcggtcccccccg

SEQ ID NO: 302993 - DNA, 557 bp, Homo sapiens
  misc_feature: GZ8MTXP01D83U6.9.71.G05.1.454.CMB.2.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgccctccgtgtctgggtctcctggacagtcgatcaccatctctgcactcggacccacactgatattggctattatactgtctctgancacacgccanacaacnccccanactcttaattatgacgtacactacgcgtccgtcgtagggtttctggtctcttcctctcgcctcagtcncgcacncgtcctcctnacactctcgtcggctcgagtctacgacgacggagtctagtaacttattactgacacgtctacgattagtcgtacttaggtttccgtttctacgtttacaagttacgttaagtcgggacggacggaccgtacgggcttacggttcccgttcgtgtacgtccaccggaccgttacgggccttaacccggtcccccg

SEQ ID NO: 302994 - DNA, 522 bp, Homo sapiens
  misc_feature: GZ8MTXP01E1EBQ.9.71.G05.1.454.CMB.2.raw
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgcccccacactcttaattangaggtcactaagcgccctcaggggtttctggtcgcttctctgcctccaagtctgcacacggcctccngaccaatctctgggctccagtctgacgacgaggctgattatactgcagctcatatgctagttggttcctntttacaagtagttagttcgggcgggagggaccaggctcgaccgtctgagtcagcccaaggcctcgccccgtcggtccncgttcttccgttccccaccctcctcagacgtaacnctaacg

SEQ ID NO: 302995 - DNA, 624 bp, Homo sapiens
  misc_feature: GZ8MTXP01BOJK6.9.71.G05.1.454.CMB.2.raw
  modified_base (297)..(297): a, c, t, g, unknown or other
  misc_feature (297)..(297): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatgggctattactaacttgtctctgatcaacacgccagacaaacgccccacactcttaattangagtcactaagccgtcctcgtagggtttctggtcgtctttcctctcgtccctacaacgtcgtacggccgtaacacccggtccctccccgtagtaaccaacttcctcgtcgggtacctaccgtaggtcctaacgggaaccgtaccgggaggttccgtaggtaactttacgttacgtcgactaacgtcttaccaaatttcgtacgtcgttggtttacggttccttaccttagaaagttataacgggtttcggacgggggtaacgttaccgaggtaccttggaccgttcctaagggactcgaccgccggacgtccgttccggtcccccgg

SEQ ID NO: 302996 - DNA, 718 bp, Homo sapiens
  misc_feature: GZ8MTXP01DD6J8.9.71.G05.1.454.CMB.2.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcacatctcctgcactgacccacactgatattgggcattataaccttgtactcctggtatcaacaacgccagacaaacgccccanactctaattangtagtcactaacgcggtccctcgtaggggtttctggtcgtctttcctccgtcgcctacccaaggtcccgtggtcccaaaccgtcccggggtaccccttaccccgtacgtaacctaaacgtcccttaccgtcggggccctttaccacggtttcctaacgggaaccggtaccggaaagggtcccttaggtaacttttaactttaaccgtcggactaacggtaccttaccgtaattaacgttcggtacgttaggttttccggtttaccccttagtttttaaccgaaacgttaagtttaacggttccgggggacgggtaaaccggggaccgtaacgggggtccttaccgggttacccgttccgttaaggacggttaaccaaccggggaccccgttaacgggtcccgttcccggggttccccccg

SEQ ID NO: 302997 - DNA, 552 bp, Homo sapiens
  misc_feature: GZ8MTXP01EJABQ.9.71.G05.1.454.CMB.2.raw
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (545)..(545): a, c, t, g, unknown or other
  misc_feature (545)..(545): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctcctgtatcaacaacgccagacaaacgccccacactcttaattangagtcactaagccggcctcgtagggttctggtcncttctctgcctccagtctggacaacncgcctcctgaccatctacgtggcctcccagtcgtgacgacgagtctagatttactactnacganctacattactgtacgtagtttcgttcccttntttacgaatcgtagtcgggnggtaaacgggcaggctgacccgtctgactcacgccgtaagcctcccgttccccgtggtaccttcgttccgttcccgtccccgtcctaacctcgaacggttctcncgtaacg

SEQ ID NO: 302998 - DNA, 619 bp, Homo sapiens
  misc_feature: GZ8MTXP01AP5NN.9.71.G05.1.454.CMB.2.raw
  modified_base (198)..(198): a, c, t, g, unknown or other
  misc_feature (198)..(198): n is a, c, g, or t
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacngtcgatcaccatctcctgccactcggacccacactgatagtgggactattactaaccttgtctcctgtactacaacaccncccagaacaaccgccccacactacttaatttangtacgtacacgtacgccggccctgtacgggtttctcggtcgtcttcctctcacctcaagtctcgcaacgccgcctcctagacactcacgttcggctcgacgtctacggaacgacgtagtacctaggttactttagtaacgtcgtacagtacttcaattcgtcgtacgttacggtttcgtttccttcgttttaccaagttattaacgggttacggccggggtaaacggttcccgaagggtccgttacggttccccgttcgtaaggtaccgtcgaaaccgtccgaacggtccgttccccggttaaccccg

SEQ ID NO: 302999 - DNA, 722 bp, Homo sapiens
  misc_feature: GZ8MTXP01DKYX0.9.71.G05.1.454.CMB.2.raw
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtcgtgggtctcctggacagtcgatcaccatctcctgcactcggacccacactgatattgggactatttactaaccttgtctctagtactacaacaacgccaagaaccaaaccgccccaactacttacttaaattagtcgaacggtacaactaaacggccggtaccttcggtaggggtttctcggtcgtactttctctacgccttacgacgtcgtacgaccgaaaccgtaccggtccctccgtacgtaacctaacttccgtcgtcggaccctaccgtaacgttcgaacggaccggtaacggacgggtacctagttaacttaacttacgtcgtaccaagttctcgtaaagttacgtcgttacgttacgtttcggttacccttagttaaacgttagtacgggtttacggtcccggggaagggtacggtaaccgtggtccttacgggtaacccgttcgtaacgggtacttaaccggacccgtaaccgtaacggttcccgtaccccggttcccctacggtacccacgtttccgttcccgtaacccctaccgtaacctagaacggttaccttaacgaacgcgg

SEQ ID NO: 303000 - DNA, 519 bp, Homo sapiens
  misc_feature: GZ8MTXP01EEQBR.9.71.G05.1.454.CMB.2.raw
  modified_base (386)..(386): a, c, t, g, unknown or other
  misc_feature (386)..(386): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccacactgatatgggctattataaccttgtctcctggtatcaacaacgcccaagaccaaacgcccccacactcttaatttatgaggtacacttaagccgccctcgaggggtttctggtcgcttctctgcctcaagtctgcaacacggcctcctagcaatctcnggctcagtctgaacgacgagctgtattagtactgcagtctcatatgctagttcgttccctntttacgatntaacgtcggcggtggaccgaggcttagccgttctgacgtcacggccagtccgttcgtcccccg

SEQ ID NO: 303001 - DNA, 599 bp, Homo sapiens
  misc_feature: GZ8MTXP01BN75X.9.71.G05.1.454.CMB.2.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (505)..(505): a, c, t, g, unknown or other
  misc_feature (505)..(505): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctctgcactcggacccacactgattagtggactattataccttgtctctgtancaacacgcagacaacncccanactacttattanagtacgtcacgtacgcgtacctggtacggtttcnggtctcttctctcgcctacagtcgtggacaccgccgtccctcgagaccagtccgtacgtcggactccgtagtcgtagaccggacgtacgtctagtactttacgttacgncgtactctntaatgttcgtacgttagttccgtttactagtttaacgaagttagtcggtcggacggacgggtacccaggtcctacggtccgtntcggtcgttccgaaagccccgtaaagggtccccttccgttaccccgttcggttcacccgttccgtacccgttccccgacctccgttaacgtccg

SEQ ID NO: 303002 - DNA, 760 bp, Homo sapiens
  misc_feature: GZ8MTXP01EAIDU.9.71.G05.1.454.CMB.2.raw
tcagtgatacgtctcacgaccggtgctcgatttagtgtcgtcgcaagagagagggggacgtctccaccatggcctgggctctgctgctcctcaccctcctcactcaggacacagggtcctgggcccctgtctgccctgactcagcctgcctccgtgtctgggtctcctggacagtcgatcaccatctcctgcactggacccaccactgatattgggcattataaccttgtctcctggtatcaacaacgccagacaaacgccccacactctaatttatagaggtacacgtaaagccggtcccctacgtacgggtttccgtggttccggtctttccctcgtccggaccttaccgtaaagttcctagggacccaaccgtaccccgggtccccttacccttacggaacctaaaacttcccgtaccgttcgggggtcccttaccccggtaagttccgtacgggtaacggaaaccgggacgggtacccttaggtaactttaattaaccgttggacccttaaaggccctttacgaattaaacgttcgggtctttaaacggtttcgggtttcccgttaccctttttacgaaaagttacgttacgttaccgggggaacggttaccggggaaccgtacggtaccggttcgaccggtcccgttaaggccgttagaaccgttacccgttaaaccgggcttaacccgcccccgttcgggtaaccctccggtaaccgttccttacccccgcccttaacccggttctaaaccggg

SEQ ID NO: 303003 - DNA, 546 bp, Homo sapiens
  misc_feature: GZ8MTXP02H1UP3.9.71.G05.1.454.CMB.2.raw
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (411)..(411): a, c, t, g, unknown or other
  misc_feature (411)..(411): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgccctccgtgtctgggtctcctggacagtcgatcaccatctcctgcactggacccacactgatattggcattataaccttgtctcctggtatcaacaacgccagacaaagcccccanactcttaattatgagtcactaagcgccctnaggggttctggtcgcttctctgcctccaagtctggcaacacggccctccctgacaatctctggctccagtctgacgacgagctgattatttacngcagtctactatatgtcgtacgtttcgttccttctttacgtaagtaagttacgttacggtacgggtacgggaccggacggtacgtacgtaccgtccgtcgtacgtacgacgaccgaccggtaccgtccgtccccg

SEQ ID NO: 303004 - DNA, 526 bp, Homo sapiens
  misc_feature: GZ8MTXP02GH1C9.9.71.G05.1.454.CMB.2.raw
  modified_base (289)..(289): a, c, t, g, unknown or other
  misc_feature (289)..(289): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgagtcactaagcgccctcgaggggtttctggtcgcttcctctgcctcaagtctggcaacacggcctccctgacatctctggcctcagtctgacgacgaggctgattattactgcatctcatatgctagtttcggttccttctttacaagtattagttcgggacggacgggtacccaggcctcgacccgttccgtgacgttcacgcccaaggtcctcgtcccccg

SEQ ID NO: 303005 - DNA, 527 bp, Homo sapiens
  misc_feature: GZ8MTXP02IMJI3.9.71.G05.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (422)..(422): a, c, t, g, unknown or other
  misc_feature (422)..(422): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaattangagtcactaagcggccctnagggtttctggtcgcttcctctgcctcaagtctggcaacacggcctccctgacaatctctggctccagtctgacgacgagctgattatactgcagctcatangctagtttggtccttctttcaaagtattacgttcgggcgggaacggaccgaggtccgtcgacccgtccgtgacgtccgacgcccgaacgccgttaccgccccccg

SEQ ID NO: 303006 - DNA, 517 bp, Homo sapiens
  misc_feature: GZ8MTXP02FY5OQ.9.71.G05.1.454.CMB.2.raw
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactctaatttatgaggtcactaaagcggccctcgaggggtttctggtcgcttcctctgcctcaagtctggcaacacggcctccctgacaatctctgggctccagtctgacgacgaggctgattattactgcagctcatangctagttcgttctcttcaagatacttcggnggtacgggaccaggctacgccttccgngacgtcacgacccaaggcctcgtcccccg

SEQ ID NO: 303007 - DNA, 502 bp, Homo sapiens
  misc_feature: GZ8MTXP02FFVUR.9.71.G05.1.454.CMB.2.raw
  modified_base (331)..(331): a, c, t, g, unknown or other
  misc_feature (331)..(331): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgagtcactaagcggccctcaggggtttcnggtcgcttcctctgcctccaagtctggcaacacggcctccctgacaatctctgggctccagtctgacgacgaggctgattattactgcagctcatatgcagttgttcctntttcaagatacttcggcggaggaccaggctgaccgtctgagtcagcccaaggctcgccccc

SEQ ID NO: 303008 - DNA, 509 bp, Homo sapiens
  misc_feature: GZ8MTXP02FZBDS.9.71.G05.1.454.CMB.2.raw
  modified_base (288)..(288): a, c, t, g, unknown or other
  misc_feature (288)..(288): n is a, c, g, or t
  modified_base (330)..(330): a, c, t, g, unknown or other
  misc_feature (330)..(330): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgaggtcactaagcggcctcaggggtttcnggtcgcttcctctgcctcaagtctggcaacacggcctccctgacatctctggctccagtctgacgacgagctgattattactgcagctcatatgcagttggttcctntttcaaagtatagttcgggcggtagggaccaggcctagaccgtctgacgtcacgcccaaggcctggcccccg

SEQ ID NO: 303009 - DNA, 534 bp, Homo sapiens
  misc_feature: GZ8MTXP02GBVXL.9.71.G05.1.454.CMB.2.raw
tcagtgatacgtctcacgaccggtgctcgatttagtgtcgtcgcaagagagaggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgagtcactaagcggccctcagggtttctggtcgcttcctctgcctcaagtctggcaacacggcctcctgacatctctggctccagtctgacgacgagctgattatactgcagctcatatgctagttgttccttctttacaagtattacgttcgggcgggtaacggacccgagggtcctacggacccgttccctggacgttcgacggccccaaagggtccctacggtccccccg

SEQ ID NO: 303010 - DNA, 519 bp, Homo sapiens
  misc_feature: GZ8MTXP02JFG1X.9.71.G05.1.454.CMB.2.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgcccagacaaacgcccccacactcttaattatgaggtcactaagccggccctcgaggggtttctggtcgcttcctctcgcctccaagtctggcaacacggcctcctgacaatctctggctccagtctgacgacgagctgacttatactgcagctnatangctagttcgtcctnttcaagntacgttcggacggacgggaccagggctacgaccgtcgtggactcgacgcccaaggtcctcgtccccccg

SEQ ID NO: 303011 - DNA, 527 bp, Homo sapiens
  misc_feature: GZ8MTXP02JOPC6.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagccggccctcaggggtttctggtcgcttcctctgcctccaagtctggcaacacggcctccctgacaatctctgggcctccagtctgacgacgaggctgattattactgcagtctcatatgctagtttgttcctctttacaagtattacgttcgggcggaacgggacccagggtctcggcccgtcctgacgtcgacgcccaaggtcctcgcccccg

SEQ ID NO: 303012 - DNA, 540 bp, Homo sapiens
  misc_feature: GZ8MTXP02GSHN1.9.71.G05.1.454.CMB.2.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgagtcactaagcggccctcagggtttctggtcgcttcctctgcctcagtctggcacacggcctcctgacatctctgggctcagtctgacgacgagctagattattactgcagctacatatgctagttcggttccttctttacaagtattacgttcgggacgggtacgggacccgaaggtcctacggacccgttccgtaaggtacgtacgacgtcccgaaggtccctccggtccccccg

SEQ ID NO: 303013 - DNA, 504 bp, Homo sapiens
  misc_feature: GZ8MTXP02F391Z.9.71.G05.1.454.CMB.2.raw
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttcctctgcctcaagtctggcaacacggcctccctgacaatctctggctccagtctgacgacgagctgattatactgcagctcatatgcagttggttcctctttcaaagatattcggcggacggaccaggctgaccgtcctgagtcacgcccaaggcctcgcccccg

SEQ ID NO: 303014 - DNA, 515 bp, Homo sapiens
  misc_feature: GZ8MTXP02I51DM.9.71.G05.1.454.CMB.2.raw
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgagtcactaagcggccctnagggtttctggtcgcttcctctgcctcaagtctggcaacacggcctccctgacatctctggctccagtctgacgacgagctgattattacngcagctcatatgctagttcggttcctntttcaagtattacgttcgggcggacgggtaccaggcctcgacccgtctgacgtcgacgcccaaggcctcgcccccg

SEQ ID NO: 303015 - DNA, 548 bp, Homo sapiens
  misc_feature: GZ8MTXP02ITU12.9.71.G05.1.454.CMB.2.raw
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacacgcccagacaaagcccccanactcttaatttatgagtcactaagcggccctgaggggtttctggtcgcttcctctgcctccaagtctggcaacncggcctcctgacaatctctggctccagtctgacgacgaggctgattattactgcagctcatatgactagtttcgttccttctttacaagtacttacgttcgggacgggtaacgggaccgtacgggtcgtcggtaacccgtcttaacggacgttcgaacggcccaacgggtcctaccggtcccccg

SEQ ID NO: 303016 - DNA, 517 bp, Homo sapiens
  misc_feature: GZ8MTXP02FW8AI.9.71.G05.1.454.CMB.2.raw
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
  modified_base (489)..(489): a, c, t, g, unknown or other
  misc_feature (489)..(489): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagccccanactctaatttatgagtcactaagcggccctcaggggtttcnggtcgcttcctctgcctcaagtctggcaacacggctccctgacatcnctgggctcagtctgacgcgaggctgattatactgcagctcatatgctagtttggttacctctttcaaagtattacgttcgggcggtacgggaccagggccttagaccgttccgngacgtcgacgccgacggcctccgccccg

SEQ ID NO: 303017 - DNA, 524 bp, Homo sapiens
  misc_feature: GZ8MTXP02H6CX6.9.71.G05.1.454.CMB.2.raw
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacacgcccagacaaagcccccanactcttaatttangaggtcactaagcgccctgagggtttctggtcgcttcctctcgcctccaagtctgggccaaacgcggcctccctgacaatctctggctcagtcngacgcgagctgattatacngctagctcatngnagtttgtccttnttacaagtatacgttcggacggtacggaccaggtctacgtacccgtcctaaggacgtacgacgccccgaaggtcctacgtcccccg

SEQ ID NO: 303018 - DNA, 543 bp, Homo sapiens
  misc_feature: GZ8MTXP02GP31I.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgagtcactaagcggccctcaggggtttctggtcgcttcctctgcctccaagtctggcaacacggcctccctgacatctctgggctccagtctgacgacgaggctgattattactgcacgtctctatatgtcgtagttcggtttccttctttacctaacgtataagttacggtcggtacgggtacgacggtacgtacgtaccgtcccgttgacgtacgtacgaccgaacgccgtcgtcccccg

SEQ ID NO: 303019 - DNA, 543 bp, Homo sapiens
  misc_feature: GZ8MTXP02HEEF4.9.71.G05.1.454.CMB.2.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccaccactgatattggcattatacttgtctctgtatcaacaacgccagacaaacgcccccacactctttaattatgagtcactaagcggccctgtagggttctgtcgtctcctctcgcctccaagtctggccaacacggccctccctgacaacttctctggaccttccagtctgacgacgaggtctgtattacttactgacacgtcactatatgctagtttcggtaccttctttacaaagtacttacgttcggcgggaacgggtacgaacgtcgtcgtaaccgtccgtgacgtcgacgaccccgaagccgtcgtcccccg

SEQ ID NO: 303020 - DNA, 514 bp, Homo sapiens
  misc_feature: GZ8MTXP02HSUZ5.9.71.G05.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattggcattataacctgtctcctgtatcaacaacgccagacaaacgcccccacactacttaatttangagtcaactaagcgccctnagggtttctggtcgcttctctgcctcaagtctggcaacacggcctccctgacaatctctggctccagtctgacgacgagctgattatactgcagctcatatgctagttcggttccttctttacaaagtattacgttcggcggacgggaccaggctcggacccgtcctgacgtcacggacccaaggcctcgcccccg

SEQ ID NO: 303021 - DNA, 526 bp, Homo sapiens
  misc_feature: GZ8MTXP02G2ZA0.9.71.G05.1.454.CMB.2.raw
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctctgtatcaacacgccagacaaacgcccccacactcttaattatgagtcactaagcgccctcgtagggtttctggtcgcttcctctgcctcaagtctggcaacacggcctccctgacaatctcgnggctcagtctgacgacgagctagattatactncagctcatatgcagtttcgttctctttacaagtatacgttcgggcggtaacgggaccgaggtctacggacccgttcgtaacgagtccgacgcccgaaacggcctccgtcccccg

SEQ ID NO: 303022 - DNA, 499 bp, Homo sapiens
  misc_feature: GZ8MTXP02FJVIK.9.71.G05.1.454.CMB.2.raw
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagccccacactctaatttatgagtcactaagcggcctcaggggtttctggtcgcttcctctgcctcagtctggcaacacggcctcctgacaatctctggctcagtctgacgacgaggctgattattactgcagctcatatgctagtttgttcctntttacaagtatacttcggcggtaggaccaggctcgaccgtcngacgtcacgccaaggctcgccccg

SEQ ID NO: 303023 - DNA, 513 bp, Homo sapiens
  misc_feature: GZ8MTXP02HW36O.9.71.G05.1.454.CMB.2.raw
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (425)..(426): a, c, t, g, unknown or other
  misc_feature (425)..(426): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccaacactcttaatttatagagtcactaaagcggccctcaggggtttctggtcgcttcctctgcctccaagtctggcaacacgcctccctgacaatcnctggctccagtctgacacgagcngatattactgnagntcatatnntagttgttcttcttactatatacgtacggacggacggacgacgcgtacgacgtcgtcgtacgtacgacgaccgacgacgtcgtcccg

SEQ ID NO: 303024 - DNA, 534 bp, Homo sapiens
  misc_feature: GZ8MTXP02I7NRY.9.71.G05.1.454.CMB.2.raw
  modified_base (293)..(293): a, c, t, g, unknown or other
  misc_feature (293)..(293): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacacncttaatttatgaggtcactaagcggccctcaggggtttctggtcgcttctctgctccaagtctgcaacacggcctccctgacaatctctgggctccagtctgacgacgagctgattagttactgcagctcatatgctagttggtttcctctttacaaagtattaacgttcgggtacggacggggacccaagggtcctagacccgtcctgacgtcacgccccaaagggcctacgtccccccg

SEQ ID NO: 303025 - DNA, 543 bp, Homo sapiens
  misc_feature: GZ8MTXP02GRYY4.9.71.G05.1.454.CMB.2.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataacccttgtctcctggtatcaacaacgcccagacaaagcccccacactcttaatttatgagtcactaagcggccctcaggggtttctggtcgcttcctctgcctcaagtctggcaacacggcctcctgacaatctctggctccagtctgacgacgaggctgattattactgcagctcatatgctagtttcggttcctcgtttacaagtattacgtttcggggcgggacgggacccgaaggtcctacggacccgttccctggacgtccacggcccccaaagggccttcggcccccccg

SEQ ID NO: 303026 - DNA, 564 bp, Homo sapiens
  misc_feature: GZ8MTXP02I5FBR.9.71.G05.1.454.CMB.2.raw
  modified_base (452)..(452): a, c, t, g, unknown or other
  misc_feature (452)..(452): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctctaggggtttctggtcgtcttcctctgcctcaagtctggcaacacggcctccctgacaatctctggctccagtctgacgacgaggctagattattactgcagtctacatatgctagtttcggttccttntttacaaagtattacgtttcgggacgggtacgggaccctaggggtcctacggaaccccgttcgtaacggacgttaccacggaccccgaaacggtcccttaccgtccccccgg

SEQ ID NO: 303027 - DNA, 532 bp, Homo sapiens
  misc_feature: GZ8MTXP02F6D34.9.71.G05.1.454.CMB.2.raw
  modified_base (287)..(287): a, c, t, g, unknown or other
  misc_feature (287)..(287): n is a, c, g, or t
  modified_base (325)..(325): a, c, t, g, unknown or other
  misc_feature (325)..(325): n is a, c, g, or t
  modified_base (408)..(408): a, c, t, g, unknown or other
  misc_feature (408)..(408): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaagccccanactcttaattatgagtcactaagcgcctcagggtttcnggtcgcttcctctgctcaagtctggcaacacggcctccctgacaatctctggctccagtctgacgacgaggctgattattacngtcagtctcatatgcagtttcgttcctgtttacaaagtacttaagttcgggacggacgggaccacgggtcctacgacccgttcctaagtacgtaccaacgcccgaaaggtcctacgtccccccg

SEQ ID NO: 303028 - DNA, 525 bp, Homo sapiens
  misc_feature: GZ8MTXP02FVFGW.9.71.G05.1.454.CMB.2.raw
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgagtcactaagccggccctcgagggtttctggtcgtcttcctctgcctcaagtctggcaacacggcctccctgacaatctctgggcctcagtctgacgacgagctgattattactgcagctcatangctagttgttcctnttacaagtntacgttcggacggtacggaccaggtctacgacccgtcgtgacgtaccacgaccccgaaggcctcgtccccccg

SEQ ID NO: 303029 - DNA, 549 bp, Homo sapiens
  misc_feature: GZ8MTXP02HGI12.9.71.G05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagcccccanactcttaatttangaggtcactaagcgcctgagggttctggtcgcttcctctgcctcagtctgcaacncgcctcctgacatctcgtggcctcagtctgacgacgagctgacttattactgcagtcctacattatgcctagtttcggttccttctttanaagtacttaagttccgggacggacgggtacccgaggtcctacggacccgttccgtaaggaacgttcgaaccggcccgaaacggggccttacccggtccccccg

SEQ ID NO: 303030 - DNA, 524 bp, Homo sapiens
  misc_feature: GZ8MTXP02IGU9P.9.71.G05.1.454.CMB.2.raw
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
  modified_base (444)..(444): a, c, t, g, unknown or other
  misc_feature (444)..(444): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataacttgtctctgtatcaacaacgccagacaaacgcccccanactcttaatttatgaggtcactaagccggcccttgaggggtttctggtcgtcttcctctcgcctccaagtctggcaacacggccctccctgacaatctntggctccagtctgacgacgaggctgattattactgcatctcatatgctagttgttcctntttacaagtatagttcggacggaggaaccagggcctcggtacctccgtaaggactcgagaccccgaggcctacgcccccg

SEQ ID NO: 303031 - DNA, 522 bp, Homo sapiens
  misc_feature: GZ8MTXP02HAEGC.9.71.G05.1.454.CMB.2.raw
  modified_base (408)..(409): a, c, t, g, unknown or other
  misc_feature (408)..(409): n is a, c, g, or t
  modified_base (411)..(412): a, c, t, g, unknown or other
  misc_feature (411)..(412): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctggtatcaacaacgccagacaagccccacactcttaatttatgaggtcactaagccgccctcgacgggtttctggtcgtcttcctctgcctcaagtctgcacacggcctcctgacaatctctggcctcagtctgacgacgagctgattattacnncnnctanatatcgtctagttcgtcttnttacagtacttacgtcggacggacggacgacgtccgtacgtacccgtacgtgtacgtaccgacgaccgacgtccgtacccgtcccg

SEQ ID NO: 303032 - DNA, 497 bp, Homo sapiens
  misc_feature: GZ8MTXP02HT7OY.9.71.G05.1.454.CMB.2.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccacactgatattgggcattataaccttgtctcctggtatcaacaacgcccagacaaagccccanactcttaattangagtcactaagcgcctcagggttcnggtcgcttcctctgcctccaagtcctggcaacacgcctccctgacatctctggctcagtctgacgacgagctgattatactgcagctcatatgctagttgtcctntttcaagtatattcggnggacggaccaggctacgaccgtcngactacgacgcccaaggcttcgcccccg

SEQ ID NO: 303033 - DNA, 563 bp, Homo sapiens
  misc_feature: GZ8MTXP02HQPVK.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgaggtcactaagcggccctcaggggtttctggtcgcttcctctgcctcaagtctggcaacacggcctccctgacatctctggctccagtctgacgacgagctgattattactgcagtctacatatgcctaggtttcggttccttactttacgaaagtacttagtttccgggacgggtacgggaccctagggtcctacggtaaccccgtcgtaacggtacgttaccgacgaccccgaaacgggtcctttaccgtcccccccgg

SEQ ID NO: 303034 - DNA, 533 bp, Homo sapiens
  misc_feature: GZ8MTXP02FVKCH.9.71.G05.1.454.CMB.2.raw
  modified_base (289)..(289): a, c, t, g, unknown or other
  misc_feature (289)..(289): n is a, c, g, or t
  modified_base (447)..(447): a, c, t, g, unknown or other
  misc_feature (447)..(447): n is a, c, g, or t
  modified_base (467)..(467): a, c, t, g, unknown or other
  misc_feature (467)..(467): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagcggccctcaggggtttctggtcgcttcctctgcctccaagtctggcaacacggcctccctgacatctctgggctcagtctgacgacgaggctgattattactgactagctacatatgctagtttggttacctntttacaagtactattcgggnggacggaccagggcttacggacccgttcctaagacgtacacggcccctaaggcctcgtaccccccg

SEQ ID NO: 303035 - DNA, 536 bp, Homo sapiens
  misc_feature: GZ8MTXP02FPBSE.9.71.G05.1.454.CMB.2.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctacgtgtctgggtctcctggacagtcgatcaccatctcctgcactggacccaccactgatattgggcattataaccttgtctcctggtatcaacaacgccagacaaagcccccacactcttaatttatgaggtcactaagcggccctcgaggggtttctggtcgcttcctctcgctcaagtctggcaacacggcctccctgacaatctctgggctccgagtctgacgacgaggctgattattactgcagctcatatgctagttcggttcctctttacaagtattacgttcggacggtacgggacctagggctcggaccgttcctaagacggttcacggtacccaagggcctcggtccccccg

SEQ ID NO: 303036 - DNA, 519 bp, Homo sapiens
  misc_feature: GZ8MTXP02IMKL4.9.71.G05.1.454.CMB.2.raw
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcccgcctccgtgtctgggtctcctggacagtcgatcaccatctcctgcactggacccaccactgatattgggcattataaccttgtctcctgtatcaacacgcccagacaaagccccacactcttaatttatgagtcactaagcgccctgagggtttctgtcgcttctcctcgcctcagtctggcacgcgcctcctgacatctcgnggctccagtctgaacgagaggctgattatacngcagctcatatgctagtttcgttcttctttacaagtattagttcggacggtaggaccgaggctacgacccgttcagaacgtcacggacccaaggtcctaccggcccccttcgg

SEQ ID NO: 303037 - DNA, 517 bp, Homo sapiens
  misc_feature: GZ8MTXP02JJTUZ.9.71.G05.1.454.CMB.2.raw
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataacctgtctcctgtatcaacaacgcccagacaaagcccccacactcttaatttatgagtcactaagcggccctgagggtttctggtcgcttcctctcgcccccaagtctggcacacggcctccctgacaatctctggctccagtctgacgacgaggctgattattactgcagctcatatgctagttggttcctctttcaaagtatagtttcggcggagggacccnggctacgaccgtcgngaacgtcgacgaccgacgtcctccgccccgtcg

SEQ ID NO: 303038 - DNA, 528 bp, Homo sapiens
  misc_feature: GZ8MTXP02F59VQ.9.71.G05.1.454.CMB.2.raw
  modified_base (436)..(436): a, c, t, g, unknown or other
  misc_feature (436)..(436): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgaggtcactaagcggccctcgaggggtttctggtcgcttcctctgcctccaagtctgacaacacggcctccctgacaatctctggctccagctgagcgagctgattatactgctgctcatatgctagatggtnacacgtcccgtggtacgttcggacgggaggaccaaagggtcgtacccgtacgtaacgggtcacgccccaagggcctacgcccccgtttccgg

SEQ ID NO: 303039 - DNA, 552 bp, Homo sapiens
  misc_feature: GZ8MTXP02HD21M.9.71.G05.1.454.CMB.2.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (374)..(374): a, c, t, g, unknown or other
  misc_feature (374)..(374): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacacgcccagacaaagcccccanactcttaatttatgaggtcactaagcggccctnaggggtttctggtcgcttcctctgcctccaagtctggcaacacggcctcccngacaatctctggcctccagtctgacgacgaggctagattattactgcagtctcatatgcgtagttcggttcctntttcaagtacttagttcgggcggtaagggacccgtagggccttacggaacccgttccgtaaggtacgtaccgacggaccccgaaggtcccgtcgtcccccccgg

SEQ ID NO: 303040 - DNA, 547 bp, Homo sapiens
  misc_feature: GZ8MTXP02J0LOW.9.71.G05.1.454.CMB.2.raw
  modified_base (510)..(510): a, c, t, g, unknown or other
  misc_feature (510)..(510): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctgtatcaacacgccagacaacgccccacactcttaatttatgagtcactaacgcgccctcgagggtttctggtcgtcttcctctgcctcagtctgcaacacggcctcctgacatctcgtggcctcagtctgacgacgaggctagacttattactgcagctacatatgacgttagttcggtttcccttgtttacaagttacttacgttccggggacgggacggggacccagggtcctacggtacccgttccgngtacgtacgacgtacccgacggtccgtccgtcccccg

SEQ ID NO: 303041 - DNA, 568 bp, Homo sapiens
  misc_feature: GZ8MTXP02GO4B6.9.71.G05.1.454.CMB.2.raw
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaaagcccccanactcttaatttatgaggtcactaagccggccctcgaggggtttcnggtcgtcttcctctgcctccaagtcctggcaacacggcctccngacatctctggctcagtctgacgacgagctgattattactgctagctcaattatgttagtttcggtttccctcttttacaaagtattacggtttacgggaccgggagggtaacccaggtcttaccgacccgttccgtggaacgttccgaacggacccaacgggtccctccggtaccccccgtttcggg

SEQ ID NO: 303042 - DNA, 546 bp, Homo sapiens
  misc_feature: GZ8MTXP02H0PB3.9.71.G05.1.454.CMB.2.raw
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgagtcactaagcgccctnagggtttctggtcgcttcctctcgcctccaagtctgcaacacgccctccctgacaatcnctggctcagtctgacgacgaggctgattattactgcagctacatatgctaggtttcgttccttatttacaagtacttacgttcgggacggtacgggacccaagggtcctcggtacccgtccgtaaggacgttaccgacgccccgaaagggtcccttccggtccccccg

SEQ ID NO: 303043 - DNA, 523 bp, Homo sapiens
  misc_feature: GZ8MTXP02GOJV3.9.71.G05.1.454.CMB.2.raw
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaacgccccacactcttaattatgagtcactaagcggccctcgaggggtttctggtcgtcttcctctgcctccaagtctggcaacacggcctcctgacaatctctggctcagtctgacgacgagctgattatactgcagctcatangctagttcggttcctntttcaagtatacgttcgggcggtacggggaccagggcttacggaccgttccgtgacgtacgacgccaacggccttcgcccccg

SEQ ID NO: 303044 - DNA, 531 bp, Homo sapiens
  misc_feature: GZ8MTXP02G6IC2.9.71.G05.1.454.CMB.2.raw
  modified_base (286)..(286): a, c, t, g, unknown or other
  misc_feature (286)..(286): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaagcccccanactcttaatttatgaggtcactaagcggccctcaggggtttctggtcgcttcctctgcctccagtctggcaacacggcctccctgacaatctctggctcatctgacgacgagctgattgtactgcagtctacatatgctaggtttcgttccttctttacaagtacttagttccgggaggacggggaccgtacggctacggacccggttctggacgttcacggcccaacggtcctcggtccccccg

SEQ ID NO: 303045 - DNA, 491 bp, Homo sapiens
  misc_feature: GZ8MTXP02H47Y2.9.71.G05.1.454.CMB.2.raw
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (468)..(468): a, c, t, g, unknown or other
  misc_feature (468)..(468): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgaggtcactaagcggccctnagggttttgtcgcttctcctgcctcaagtctggcacacggcctccctgacaatctctggcnccagtctgacgacgaggctgattatactgcagctcatatgctagtgttcntttcagntatcggngaggacaggctgaccgttcgngaacgcacgccagctcgcccgtg

SEQ ID NO: 303046 - DNA, 522 bp, Homo sapiens
  misc_feature: GZ8MTXP02FUTWY.9.71.G05.1.454.CMB.2.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctggtatcaacaacgcccagacaaacgcccccacactcttaatttatgaggtcactaagcgccctnaggggtttcnggtcgcttcctctgcctcaagtctggcaacacggcctccctgacaatctctggctcagtctgacgacgagctgattatactgcagctcatatcgctagttggttcctcgtttacaagtatacgttcggacggtacgggacccaaggccttcgacccgtccgtgacgtcacgcccaaggcctcgtcccccg

SEQ ID NO: 303047 - DNA, 559 bp, Homo sapiens
  misc_feature: GZ8MTXP02GSHIZ.9.71.G05.1.454.CMB.2.raw
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (453)..(453): a, c, t, g, unknown or other
  misc_feature (453)..(453): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgcccagacaaagcccccanactcttaatttatgaggtcactaagcgccctnagggtttctggtcncttcctctgcctcagtctggcaacacggcctccctgacaatctctgggctcagtctgacgacgaggctgattattactgcagctcatatgctagttggtttcctcgttttacaaagtnttaacgttccgggacgggacgggtacccgaagggtcctacggtaacccgttccgttggaacgttccgaacggtccccgaaacgggtcccgtaccggtcccccccgg

SEQ ID NO: 303048 - DNA, 547 bp, Homo sapiens
  misc_feature: GZ8MTXP02JTIX6.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctggtatcaacacgcccagacaaagcccccanactcttaatttatgagtcactaagcggccctcgtagggtttctggtcgcttcctctgcctcagtctggcaacacggcctccctgacaatctctggctccagtctgacgacgaggctagattattactgcagctacatatgtctaggtttcggttccttactttacaaagtattaacgttcgggacggaacggggaccaacgggtcctcggtaacccgtcgtaacgacgtacacgcccgaaacggcctacggtccccccg

SEQ ID NO: 303049 - DNA, 526 bp, Homo sapiens
  misc_feature: GZ8MTXP02GYPXS.9.71.G05.1.454.CMB.2.raw
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatatgggcattataaccttgtctcctggtatcaacacgcccagacaaagcccccacactcttaatttatgaggtcactaagcggccctcaggggtttctggtcgcttctctgcctccaagtctggcacaccggcctcctgacaatctctggggctccagtctgacgacgaggctgattattactgcagctcatatgctagttggttccttctttacaagtattagttcggcggagggaccaggtctggaccgtccgtgacgtcacgcccgaaacggctcgccccctcggtcaccgtctcgtcccgccctcctactaccg

SEQ ID NO: 303050 - DNA, 529 bp, Homo sapiens
  misc_feature: GZ8MTXP02I60XA.9.71.G05.1.454.CMB.2.raw
  modified_base (291)..(291): a, c, t, g, unknown or other
  misc_feature (291)..(291): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccanactcttaatttatgagtcactaagcggccctcgagggtttctggtcgcttcctctgcctcagtctgcaacacggcctcctgacatctctggctccagtctgacgacgagctgattattactgcagtctcatatcgctagtttcggttccttctttacaaagtnttaacgttcgggcggacgggaccaggctacggacccgttccgtgacgtcacgcccgaacggtcctcgtccccccg

SEQ ID NO: 303051 - DNA, 522 bp, Homo sapiens
  misc_feature: GZ8MTXP02JL8W1.9.71.G05.1.454.CMB.2.raw
  modified_base (365)..(365): a, c, t, g, unknown or other
  misc_feature (365)..(365): n is a, c, g, or t
  modified_base (456)..(456): a, c, t, g, unknown or other
  misc_feature (456)..(456): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcgaggggtttctggtcgcttcctctgcctcaagtctggcaacncggcctccctgacatctctggctccagtctgacgacgaggctgattattactgcagctcatatcgctagtttcgttcctctttacaaagtnttacgttcgggcggacggaccagggcctcgaccgtctgacgtcacgcccaaggtcctcgtcccccg

SEQ ID NO: 303052 - DNA, 518 bp, Homo sapiens
  misc_feature: GZ8MTXP02HGDE3.9.71.G05.1.454.CMB.2.raw
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctggtatcaacaacgcccagacaaacgcccccacactcttaattatgagtcactaagcgcctgagggtttctggtcgcttcctctgcctcaagtctggcaaacacggcctccctgacaatctctggctccagtctgacgacgaggctgattattactgaccngctnatatgcgtagttcgttcttacttanaagtattacgtcggaggacggacgacggtctacgtccgtcngacgtcgacgaccgacgtccgtccgccccg

SEQ ID NO: 303053 - DNA, 681 bp, Homo sapiens
  misc_feature: GZ8MTXP02FLF47.9.71.G05.1.454.CMB.2.raw
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtactacaacacnccanaacaaccgcccacactacttaattatgagtcaacagccgtcctcggtaggtttcgtggtcgtcttctctcgccctacgtaacgtcgtcgaccaaccgaccccggtcccctcccgtacgaactaacttcctcggtcgggtcctacgtacgtcgtacgacgacgggacgtctagtaatttactacgtgacagtcctactaaagttgtcgtacgtttacggtttccgtttcctttacgttaagaagttaacgttacggggtaccgggggacggggtaaccgggaccggttacggtccgttaccgggttacccgttcggtacggtaccgtaccgaacccgggtacccggtaacggtcccgtacccccgtcccggttccgtaaccgttccgtttacccgttccccgttaccccctaccctaccgtacgtaacgg

SEQ ID NO: 303054 - DNA, 565 bp, Homo sapiens
  misc_feature: GZ8MTXP02G9JT0.9.71.G05.1.454.CMB.2.raw
  modified_base (412)..(412): a, c, t, g, unknown or other
  misc_feature (412)..(412): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctgtatcaacaacgcccagacaacgcccccacactacttaatttatgagtcactaagccgccctcgtaggggtttctggtcgtcttcctctcgcctaccaagtctggccaaacgacggtccctcccgtgacaactcctctgggcctccagttcngacgacgaggtctagtattacttactgactagtctctatatgactagtttcggtccttcttacgaagtaattacgttcgggcggaacggacccaggtccgtacgtacccgtcctgaacgtccgacgcccccgaaggtccctccggtccccccg

SEQ ID NO: 303055 - DNA, 513 bp, Homo sapiens
  misc_feature: GZ8MTXP02GALL7.9.71.G05.1.454.CMB.2.raw
  modified_base (485)..(485): a, c, t, g, unknown or other
  misc_feature (485)..(485): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgagtcactaagcggccctcagggtttctggtcgcttcctctgcctcaagtctggcaacacggcctccctgacaatctctgggctccagtctgacgacgaggctgattattactgcagctcatatgctagttgtttcctctttacaagtatacttcggcggacgggaccaggctcgccgttccngagtcacgccccaaaggcctgtcccccg

SEQ ID NO: 303056 - DNA, 564 bp, Homo sapiens
  misc_feature: GZ8MTXP02I9HM8.9.71.G05.1.454.CMB.2.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcagggtttctggtcgcttcctctgcctcaaagtctggcaacacggcctcctgacaatctctggctcagtctgacgacgagctgattattactgcagtctcatatgctagtttcggttccttctttacaaagtattaacgtttcgggacggtaagggacccaagggtcctacggtacccgttcccgtggtaacgttccgaaacggcccccgaaacgggtcccgtttaccggtccccccccgg

SEQ ID NO: 303057 - DNA, 586 bp, Homo sapiens
  misc_feature: GZ8MTXP02GINTB.9.71.G05.1.454.CMB.2.raw
  modified_base (287)..(287): a, c, t, g, unknown or other
  misc_feature (287)..(287): n is a, c, g, or t
  modified_base (327)..(327): a, c, t, g, unknown or other
  misc_feature (327)..(327): n is a, c, g, or t
tcagtgatacgtctcacgaccggtgctcgatttagtgtcgtcgcaagagagaggggggggtcacaagaggcagcgctctcgggacgtctccaccatggcctgggctctgcttctcctcaccctcctcactcaggacacagggtcctgggccctgtctgccctgactcagcctgcctccgtgtctgggtctcctggacagtcgatcaccatctcctgcactggacccacactgatattggcattataacttgtctcctgtatcaacaacgcccagacaaacgccccanactcttaattatgagtcactaagcgccctgaggggtttcnggtcgcttctcctgcctcaagtctggcacgacggcctcctgacatctctgggctccagtctgacgacgaggtctagtattattactcgcagtctactatatgcctaggtttcggtttccttacgtttacaaagtacgttacggtttaccgggacgggaacgggtacccgtagggtaccttcgggaacccgttccgttaggaacggttaccgaaaccggccccggtaaacgggtcccttacccggacccccgtttccggg

SEQ ID NO: 303058 - DNA, 543 bp, Homo sapiens
  misc_feature: GZ8MTXP02HHAH8.9.71.G05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (433)..(433): a, c, t, g, unknown or other
  misc_feature (433)..(433): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtatcaacaacgccagacaaagcccccanactcttaatttangagtcactaagccggccctcgaggggtttctggtcgtcttccctctcgcctcaagtctggcaacacggccctcctgacaatctctgggcctcagtctagacgacgaggctgatttatactgcagctacatangctagttcggttccttcttacaagtacttacgttcgggacggacgggacctacggcctacggtaccgtcctaaggacgtccgacgcccgaaggtccctaccgtccccccg

SEQ ID NO: 303059 - DNA, 572 bp, Homo sapiens
  misc_feature: GZ8MTXP02JZZVO.9.71.G05.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagcgccctcagggtttctggtcgcttcctctgcctccagtctggcacacggcctcctgacaatctctggctccagtctgacgacgaggctgattatactgctagctacatatgctagtttcggttccttctttacaaacgtagttaacgtttccggggacgggtaacggggacccacgggtcctacggtaaccccgttcccgttaaggaaccgttccgaccggtaccccgaaacgggtacccttaccggtcccccccgg

SEQ ID NO: 303060 - DNA, 570 bp, Homo sapiens
  misc_feature: GZ8MTXP02GUF4E.9.71.G05.1.454.CMB.2.raw
  modified_base (422)..(422): a, c, t, g, unknown or other
  misc_feature (422)..(422): n is a, c, g, or t
  modified_base (426)..(427): a, c, t, g, unknown or other
  misc_feature (426)..(427): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgctcctggtatcaacaacgcccagacaaacgcccccacactcttaatttatgaggtcactaaagcgccctcgagggtttctggtcgtcttccgtctgcctcaagtctcggcaacgacggcctccctgacaatctctcggctccatctgacgacgagctgacttattacgngacnnctatatatcgtcgttaggtttcgttccttacgttacgtaagtaacttacggtcgggacgggtaacggaccgaggtaccgtacggtacccgttcgtaaggtaccgtacgaaccggacccgtaacggtccctacccggtcccccg

SEQ ID NO: 303061 - DNA, 518 bp, Homo sapiens
  misc_feature: GZ8MTXP02FUWEU.9.71.G05.1.454.CMB.2.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (434)..(434): a, c, t, g, unknown or other
  misc_feature (434)..(434): n is a, c, g, or t
  modified_base (494)..(494): a, c, t, g, unknown or other
  misc_feature (494)..(494): n is a, c, g, or t
  modified_base (509)..(509): a, c, t, g, unknown or other
  misc_feature (509)..(509): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgcccagacaaagcccccacactcttaatttatgaggtcactaagcggccctcgtaggggtttctggtcgtcttcctctcgcctcaagtctggcaacncggcctccctgacatctntggctcagtcngacgacgagctgattattactgacagctacatagtcgntagtttcgttcctctttacagtattacgtcgggaggacgggaccagggtctacgccgtcngagtcacgccagccncgtaccccg

SEQ ID NO: 303062 - DNA, 595 bp, Homo sapiens
  misc_feature: GZ8MTXP02JLXAV.9.71.G05.1.454.CMB.2.raw
  modified_base (263)..(263): a, c, t, g, unknown or other
  misc_feature (263)..(263): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacacgcccagacaaacgccccanactcttaatttatgaggtcactaagcggccctcgtaggggtttctggtcgtcttctctcgcctccaagtctggcaacacccggcctcctgacatctctgggctcagtctgacgacgaggctgattatactgcagctacatatgctagtttcggttccttctttacaagtacttagttaccggggcggtaacggggaccgagggtccgtacggtaacccgtccgttacggacgttccgacggaccccgaaaggtcccgtccgtccccccgttgggtcccttaccgttcccgttcccgttccccccggtccctttccccgtacgtaaaccccgg

SEQ ID NO: 303063 - DNA, 516 bp, Homo sapiens
  misc_feature: GZ8MTXP02FUJYQ.9.71.G05.1.454.CMB.2.raw
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagcccccacactcttaattatgaggtcactaagcggccctcgagggtttcnggtcgcttcctctgcctccaagtctggcaacacggcctccngacaatctctggctcagtctgacgacgagctgattatactgcagctcatangcagttgttcctnttacaagtatacgttcggcggacgggaccagggctacgacccgtccgtaagacgtcacggcccaaggtcctcgtcccccg

SEQ ID NO: 303064 - DNA, 547 bp, Homo sapiens
  misc_feature: GZ8MTXP02JC63Y.9.71.G05.1.454.CMB.2.raw
  modified_base (288)..(288): a, c, t, g, unknown or other
  misc_feature (288)..(288): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacacgccagacaaacgcccccanactcttaatttatagagtacactaagcggcccctgaggggtttctggtcgtcttcctctcgccacaagtctggcaacacggcctccctgacaatctctggctccagtcctgacgacgaggctgacttattactgtcagctacatatgctaggtttgttcccttgtttacaagtnttacgttcgggacgggacgggaaccaggtccgtacgtacccgtccgtaaggcgtacgacggccccaaaggtccctcggtcccccg

SEQ ID NO: 303065 - DNA, 598 bp, Homo sapiens
  misc_feature: GZ8MTXP02HEIT3.9.71.G05.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagccggccctcaggggtttctggtcgcttcctctgcctccaagtctggcaaacacggcctccctgacaatctctgggctccagtctgacgacgaggctgattattactgcagctcatatgctagtttcggtttacctcgttttacaaagtactttaacgtttccggggcgggtaacggggtaacccgaagggtccgttacggaaccccggttcccgtaagggtaaacggtttcccgaacgggaccccccgtaaaaggggtccccgttaaccgggtccccccccgg

SEQ ID NO: 303066 - DNA, 589 bp, Homo sapiens
  misc_feature: GZ8MTXP02ICTS7.9.71.G05.1.454.CMB.2.raw
  modified_base (383)..(383): a, c, t, g, unknown or other
  misc_feature (383)..(383): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctcgtgtctggtctctggacagtcgatcaccatctcctgcactcggacccacactgatattgggctattataaccttgtctcctgtatcaacaacgcccagacaaacgcccccacactacttaattatgaggtcactaagcggccctgtagggttctggtcgtcttcctctcgcctcaagtctcggcaaccgacgccctccctgacatcnccgtggctcagtctgacgacgagctagattatacgtgtacagtctacattatcgtacgttagtttccgttacctttacgttacgaagttacgttacggttaccggggacggtaacggtaccggtacggtccgttaccggtacccgttacgtaacggtaacgtaccggaccgtaccccggtaccggtcccgttaccccggtcccccg

SEQ ID NO: 303067 - DNA, 598 bp, Homo sapiens
  misc_feature: GZ8MTXP02GJ6BL.9.71.G05.1.454.CMB.2.raw
  modified_base (328)..(328): a, c, t, g, unknown or other
  misc_feature (328)..(328): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgatattgggctattataaccttgtctctgtatcaacacgccagacaaacgccccacactcttaatttatgagtcactaacgcgcctcgtagggtttcnggtcgtcttcctctcgctaccaagtctcggcaacaccggcctccctgaactaactcttcgtcgggcctaccgacgttctagaacgacgacgggcttggtaattacgttactgcaacgtcttacaattaatcgacgttacggtttcggtttcccttcttttaacgaaaagtacgttacgtttacgggacggtaaccggggacgtacgggcgtacggacccgttcgaacgtacgtacgaaccgacccgaacggtccgttaccgttcccccgg

SEQ ID NO: 303068 - DNA, 539 bp, Homo sapiens
  misc_feature: GZ8MTXP02J20JJ.9.71.G05.1.454.CMB.2.raw
  modified_base (289)..(289): a, c, t, g, unknown or other
  misc_feature (289)..(289): n is a, c, g, or t
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagttggctattataaccttgtctcctgtatcaacacgccagacaaacgccccanacttctaatttatgaggtcacgtaacgcggccctcgtagggttctggtcgtcttcctctgcctcagtcngcacacgcctctgacatctctcggctccgagtcgngacgagacggtctagtattaattccgngcactctactatagtcgtacgttacgttcgttcttacttacgtagtagtacgtacggacggacggacgacgtcgtacgtaccgtcgtcgtacgacgacgaccgacgtccgtccgtcccg

SEQ ID NO: 303069 - DNA, 523 bp, Homo sapiens
  misc_feature: GZ8MTXP02I7MCB.9.71.G05.1.454.CMB.2.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
tcagtgatacgtctcacgaccggtgctcgatttagtgtcgtcgcaagagagaggggggggtcacaagaggcagcgctctcgggacgtctccaccatggcctgggctctgcttctcctcaccctcctcactcaggacacagggtcctgggccctgtctgccctgactcagcctgcctccgtgtctggtctcctggacagtcgatcaccatctcctgcactggacccaccactgatattggcattataaccttgtctcctgtatcaacacgcccagacaaagccccanactcttaattangagtcactaagcgccctnagggtttcngtcgcttctcctcgcctccaagtctggacacacgcctcctgacaatctctggctcagtctgacgacgaggctgtatatactgcagctcatatgactagttcggttccttctttacaaagtattagttcgggacggagggaacccaggtcgtcgaccgtccgtgaacgtcaacggcccaaaggtcctcgcccccttcgg

SEQ ID NO: 303070 - DNA, 555 bp, Homo sapiens
  misc_feature: GZ8MTXP02IKADR.9.71.G05.1.454.CMB.2.raw
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgccctccgtgtctgggtctcctggacagtcgatcaccatctcctgcactggacccacactgatattgggcattataaccttgtctcctggtatcaacaacgccagacaaacgcccccacactcttaatttatagagtcactaagccggccctcgaggggtttctggtcgtcttcctctcgcctccaagttcctggccaacacggccctccctagacaatctctggcctcagtctgacgacgagctgattatacngcagtctcatangactagtttcgttccttactttacaaagtattacgttcgggacgggacggtaaccagggtcctacgtaacccgtccgtaagacgtacacgtacccgaaggtcctacggtaccccccg

SEQ ID NO: 303071 - DNA, 541 bp, Homo sapiens
  misc_feature: GZ8MTXP02IU6CP.9.71.G05.1.454.CMB.2.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
  modified_base (447)..(447): a, c, t, g, unknown or other
  misc_feature (447)..(447): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgaggtcactaagcggccctnaggggtttctggtcgcttcctctgcctccaagtctggcaacacggcctcctgacaatcnctggctccagtctgacgacgaggctgattattaactgtcagtctacatatgcagtttggttccttntttacaaagtattacgttcgggcggtacgggacccgtaaggcctcgaacccgtcctaaggacgttcgacgcccgaaacggccttacgccccccg

SEQ ID NO: 303072 - DNA, 553 bp, Homo sapiens
  misc_feature: GZ8MTXP02HZHNG.9.71.G05.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactggacccacactgatattggcattataaccttgtctcctggtatcaacaacgcccagacaaacgcccccanactctttaattatgaggtcactaagcggcctcaggggttctggtcgcttcctctgcctcaagtctgcacacggcctccctgacaatctctggctcagtctgacgaccgaggctgattatactgcagtctacatatgactagtttgtcctgtttacaagtcttagttcgggacggtaacgggacccaagggtccttacggaacccgttccgtaaggtaacgttaccgacggacccccaaagggtccctttaccggtcccccccg

SEQ ID NO: 303073 - DNA, 572 bp, Homo sapiens
  misc_feature: GZ8MTXP02I5PTM.9.71.G05.1.454.CMB.2.raw
  modified_base (411)..(411): a, c, t, g, unknown or other
  misc_feature (411)..(411): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataacctgtctcctgtatcaacacgccagacaacgcccccacactacttaattatgaggtcactaagcgcctcgtagggttctggtcgcttcctctgcctcagtctcgcaccacgcctcctgacactctcgtggcctcagtctgacgacgaggctagattattacgngcacgtctatatagtcgtacgttagtttcgtttccttacttacgtaagttacgttacggttaccggggacgggtaacggtaccggtacggtccgtaccggtacccgtacgtcggtaccgtaccgaccggtacccggtacggtcccgttaccccggtccccg

SEQ ID NO: 303074 - DNA, 564 bp, Homo sapiens
  misc_feature: GZ8MTXP02IP54H.9.71.G05.1.454.CMB.2.raw
  modified_base (290)..(290): a, c, t, g, unknown or other
  misc_feature (290)..(290): n is a, c, g, or t
  modified_base (431)..(431): a, c, t, g, unknown or other
  misc_feature (431)..(431): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccacactgatattggcattataaccttgtctcctgtatcaacaacgcccagacaaagcccccanactctttaatttatgaggtcaactaagcggccctcgaggggtttctggtcgtcttcctctcgcctcaagtctggcaacacggccctccctgacaatctctggctcagtctgacgacgaggctagattattactagcacgtntcattactgtctaggtttcggttcccttcttttacaaagtattacgttcgggacggacgggtaacccgaggtccgtcggtaaccgtccgtaaggtacgtacaccggaccgaacgggtcctaccggtccccccg

SEQ ID NO: 303075 - DNA, 516 bp, Homo sapiens
  misc_feature: GZ8MTXP02FO9E0.9.71.G05.1.454.CMB.2.raw
  modified_base (289)..(289): a, c, t, g, unknown or other
  misc_feature (289)..(289): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgaggtcactaagcgccctcaggggtttctggtcgcttcctctgcctcagtctggcaacacggcctccctgacaatctctgggctccagtctgacgacgaggctgattattactgcagctcatatgctagttcggttcctctttacaaagatacgtttcgggacggacgggaccaggctcgaccgtctgacgtcacgcccaagcctcgtcccccg

SEQ ID NO: 303076 - DNA, 544 bp, Homo sapiens
  misc_feature: GZ8MTXP02JFDNS.9.71.G05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (436)..(436): a, c, t, g, unknown or other
  misc_feature (436)..(436): n is a, c, g, or t
tcagtgatacgtctcacgaccggtgctcgatttagtgtcgtcgcaagagagagggggggtcacaagaggcagcgctctcgggaagtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagcccccanactcttaatttangaggtcactaagccggccctcgtacggggtttctggtcgtcttcctctcgcctccaagtctgcaacacggcctccctgacaatctcgtggcctcagtctgacgacgaggctgattattactgcagctacattangactagttcggttccttgtttacagtacttagttcgggacggtacgggaccgaggtctacggacccgtactggacgtacgacgacccgaacggccttccggtcccccg

SEQ ID NO: 303077 - DNA, 533 bp, Homo sapiens
  misc_feature: GZ8MTXP02GZ2OU.9.71.G05.1.454.CMB.2.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagagagggggggtcacaagaggcagcgctctcgggacgtctccaccatggcctggactctgctgctcctcaccctcctcactcaggacacagggtcctgggccctgtctgccctgactcagcctgcctccgtgtctgggtctcctggacagtcgatcacatctcctgcactgacccacactgatattgggctattataaccttgtctcctggtatcaacaacgcccagacaaagcccccanactacttaatttangagtcactaagccggccctcgtagggttctggtcgtcttcctctgcctccaagtctggcaacacggcctccctgacatctctggctccagtctgacgacgaggctgtattattacngcacgtctacatangtacctaggtttcgttcccttntttacaaagtattacgttcgggcggtacggacctagggctcgaccgtctgacgtcaacgcccaaggccttacgcccccg

SEQ ID NO: 303078 - DNA, 577 bp, Homo sapiens
  misc_feature: GZ8MTXP02JTZN8.9.71.G05.1.454.CMB.2.raw
  modified_base (278)..(278): a, c, t, g, unknown or other
  misc_feature (278)..(278): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccganaacgaccccaccactacttaactttatgaggtcactaagtcgccgtccagggtttacgtggtcgcgttctccctgtccgtccaacgtctcggcacaacggcctccctgacgaactcttactcggcgtccagtctgacgacgaggctgattacttatagcagctcagtatgctagttcggttctcctttcaggtataacgtttcggacggacgggacgacggtacgtcggtaaccgtcccgttggaacggttaccgacgacccccgaaacggtacccgtacgtccccccgttaccccggg

SEQ ID NO: 303079 - DNA, 515 bp, Homo sapiens
  misc_feature: GZ8MTXP02H9V3T.9.71.G05.1.454.CMB.2.raw
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattanaaccttgtctcctggtatcaacaacgccagacaaagccccanactcttaattangagtcactaagcgcctnagggttctggtcgcttcctctgcctcaagtctggcaacacggcctccctnacaatctctggctccagtctgacgacgagctgattattacgngcagtctanatatgactagttcgttccttcttacaagtattacgtcggacggacggacgacggtctacgaccgtcgtaagacgtcacgaccgacggcctccgccccg

SEQ ID NO: 303080 - DNA, 533 bp, Homo sapiens
  misc_feature: GZ8MTXP02IEGWN.9.71.G05.1.454.CMB.2.raw
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgagtcactaagcgccctgaggggtttctggtcgcttcctctcgcctcaagtctgcaacacgcctccctgacaatcnctggctccatctgacgacgngactgtattatactgctagcctnatatgctagttcgttctctttcgaagtatacgttcgggcggtaacggaccgaggtccgtacggtacccgtccgtggacgtacgaccgacccgtaaggccctcggtccccccg

SEQ ID NO: 303081 - DNA, 662 bp, Homo sapiens
  misc_feature: GZ8MTXP02JKQTU.9.71.G05.1.454.CMB.2.raw
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctccngcacgtcgacccacactgattagttggactattactaacttgtctctgtatcaacacnccagacaacgccccanactcttaatttngtagtcaataagccgtcctgtagggttctggtctctcctctgccctacagtctggccaacgacggtcccttaccagaactacgtctcgtcggtacctccgagttcgtagaccgacgacggtcttagtaactttattacgcgacacgtcctacgtaacttacgtgtaccgttagggttttaccggtttcccttacggtttttaaaccaaaacgggtttatttaaacgggtttcccggggacggggtaaaccggggtaaaccccggtacgggttacccgtaccggtacccggttaccgtaacggtaaccggtaaccgaaaccggtaacccgtaaccggtaccccgttaccccggtaacccccg

SEQ ID NO: 303082 - DNA, 556 bp, Homo sapiens
  misc_feature: GZ8MTXP02FPQFS.9.71.G05.1.454.CMB.2.raw
  modified_base (287)..(287): a, c, t, g, unknown or other
  misc_feature (287)..(287): n is a, c, g, or t
  modified_base (330)..(330): a, c, t, g, unknown or other
  misc_feature (330)..(330): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaagccccanactcttaatttatgaggtcactaagcggccctcaggggtttcnggtcgtcttcctctgcctccaagtctggcaacacggcctccctgacaatctctgggctccagtctgacgacgagctgattatactgcagctcatatgctagttcggttcctctttacgaagtattacgttcgggacgggtacgggaacccgaggtccgtacggacccgttcccgtaaggtacgttacgaaccggaccccgaaacggtccgtaccggtcccccccgg

SEQ ID NO: 303083 - DNA, 563 bp, Homo sapiens
  misc_feature: GZ8MTXP02GYN0W.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctgtatcaacaacgccagacaacgccccacactcttaattatgaggtcactaagcgccctcgtagggtttctggtctcttcctctcgcctccaagtctggcaacacgcctccctgacaatctctggctccagtctgacgacgaggctagtattatactgcagctacatatgtctaggtttcggttccttcttaccgaaagtattaacgtttcggggacgggtacgggaccgagggtcctacggtacccgttacccgtggaacgtccgaacggacccccgaaggtcccgtaccggtcccccccgg

SEQ ID NO: 303084 - DNA, 522 bp, Homo sapiens
  misc_feature: GZ8MTXP02FXVTD.9.71.G05.1.454.CMB.2.raw
  modified_base (367)..(367): a, c, t, g, unknown or other
  misc_feature (367)..(367): n is a, c, g, or t
  modified_base (495)..(495): a, c, t, g, unknown or other
  misc_feature (495)..(495): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagccggccctcgtaggggtttctggtcgcttcctctgcctcaagtctggcaacncggcctccctgacaatctctggctccagtctgacgacgaggctgattattactgcagctcattatgctagtttcggttcctctttacaagtatacgttcggacggaggaccaggcttacgacccgtcngactcacgcccaaggcctcgtcccccg

SEQ ID NO: 303085 - DNA, 548 bp, Homo sapiens
  misc_feature: GZ8MTXP02JZXUQ.9.71.G05.1.454.CMB.2.raw
  modified_base (289)..(289): a, c, t, g, unknown or other
  misc_feature (289)..(289): n is a, c, g, or t
  modified_base (422)..(422): a, c, t, g, unknown or other
  misc_feature (422)..(422): n is a, c, g, or t
  modified_base (474)..(474): a, c, t, g, unknown or other
  misc_feature (474)..(474): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgcccccanactcttaatttatgagtcactaagcggccctcgaggggtttctggtcgcttcctctgcctccaagtctggccaacgacggccctcctgacaatctctgggcctccgagtctgacgacgaggctgattattacngcagctcatatgctagtttcggttccttctttacgaagtattacgttcgggngggtaacgggacccaggcctacggacccgttccgtaagacggtccacggccccaagggtccctcggtccccccg

SEQ ID NO: 303086 - DNA, 525 bp, Homo sapiens
  misc_feature: GZ8MTXP02F5GFT.9.71.G05.1.454.CMB.2.raw
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgaggtcactaagcgccctcaggggtttctggtcgcttcctctgcctccaagtctggcaacacggcctccctgacaatctctgggctccagtctgacgacgaggctgattatactgcagctcatatgcagtttgttcctctttacaagtattagttcgggaggtacgggaccaggcctcggacccgttccgtgacgtcgacgtcccgaaggcctcggtccccccg

SEQ ID NO: 303087 - DNA, 532 bp, Homo sapiens
  misc_feature: GZ8MTXP02GZGEJ.9.71.G05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtatcaacaacgccagacaaacgccccanactcttaattangagtcactaagcgcctcgtagggttctggtcgtcttcctctcgcctcaagtctggcaacacggcctcctagactaatctacgtcggctccagtctgacgagagctagacttatactgacagctacatangctagtttcgtacttcttagaacgtnttacgtcggacggtacggaccgacggctacgacccgtcctggaacgttccgacgtcccgaagtcccgtcgtcccccg

SEQ ID NO: 303088 - DNA, 585 bp, Homo sapiens
  misc_feature: GZ8MTXP02I7X3Q.9.71.G05.1.454.CMB.2.raw
  modified_base (305)..(305): a, c, t, g, unknown or other
  misc_feature (305)..(305): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctcctggtatcaacaacgcccagacaaacgcccccacactcttaatttacngaggtcactaagccggccctcgaggggtttctggtcgtcttcctctgcctccagtctggcaacacgcctcctgacatctctgggactccagtctgacgacgaggctgatttatactgacagctcatatgactaggtttcggttccttactttcaaagtacttacgtttccgggacggtaacgggggacccaagggtccgtacggtaacccggttcccgtaaggtacgttacccgaacggtacccccgaaaacggggtcccttaccggttcccccccccgg

SEQ ID NO: 303089 - DNA, 598 bp, Homo sapiens
  misc_feature: GZ8MTXP02JITK6.9.71.G05.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgcccagacaacgcccccanactcttaatttatgaggtcactaagccggcctcgtaggggtttctggtcgtcttccctctcgcctcaagtctggctaacacggtcctccctgacatctcgtggctccagtctgacgacgaggctgattatactgacagctcatatcgactacggtttcggttccttacttttaccgaaagtacgttacgtttaccggggacgggtaacggggacccgtacggggtccgttacggtaaccccggttaccgtggtaacgttaccgtacggacccccggtaaagggtcccttacccgggttacccccccgg

SEQ ID NO: 303090 - DNA, 585 bp, Homo sapiens
  misc_feature: GZ8MTXP02HDPVV.9.71.G05.1.454.CMB.2.raw
  modified_base (283)..(283): a, c, t, g, unknown or other
  misc_feature (283)..(283): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattatacttgtctctgtatcacaacgccagacaacgccccanactcttaatttatgaggtcactaagccggccctgtacggggtttctggtcgtcttccctctcgtccctccaagtctggcaacgacggtcctccctgacaactctctgggcctcgagtctgacgacgaggctagattattactgcacgtctacatactcgtaccgtagtttcggttccctttacgtttaccgtaaaagtacttaacggtttccggggacggggttaacgggacccgtagggtccttacggacccgttccgtggacgttcgaacgtacccgaacgggtccttccgtccccccgg

SEQ ID NO: 303091 - DNA, 513 bp, Homo sapiens
  misc_feature: GZ8MTXP02G6G5R.9.71.G05.1.454.CMB.2.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattggccattataaccttgtctcctgtatcaacaacgccagacaaagccccacactcttaattatgaggtcactaagcgccctgagggtttctggtcgtcttctctcgcctccaagtctcggcaacacggcctcctgaccaactctcgtggctccagtctgacgacgagctgattatactgcagctcatatgctagttcgttctnttcantatggngaggaccnggncgactctgagtcacgaccgaaggcctcggcccccctggtccaccttctccgttaaccccaccctttccacacgtacctactacgacg

SEQ ID NO: 303092 - DNA, 515 bp, Homo sapiens
  misc_feature: GZ8MTXP02IW9DY.9.71.G05.1.454.CMB.2.raw
  modified_base (290)..(290): a, c, t, g, unknown or other
  misc_feature (290)..(290): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacaacgcccagacaaagcccccanactcttaatttatgaggtcactaacgcggccctcagggtttctggtcgtcttccgtctcgcctccaagtctgcaacacggccctccctgacaatctctcgggctccagtctgacgaccgaggcctgattattacgtgcagctcattangctagttcgttctctttcaaagtntacgttcggcggtacggcaggctgacccgtcngatcacgccagcctcgccccg

SEQ ID NO: 303093 - DNA, 502 bp, Homo sapiens
  misc_feature: GZ8MTXP02IHPOP.9.71.G05.1.454.CMB.2.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctgtatcaacaacgcccagacaaacgccccanactcttaatttangagtcataagcgccctnagggtttctggtcgcttcctctcgcctcaagtctggcaacacgcctccctgacaatctctggctccagtctgacgagaggctagattaacttactgcagctcatatgctagttgttcctntttcaagnttatccggnggacgaccgaggctgaccgttcgngactcgacgaccgacgctccgcccg

SEQ ID NO: 303094 - DNA, 517 bp, Homo sapiens
  misc_feature: GZ8MTXP02J3MF0.9.71.G05.1.454.CMB.2.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactggacccaccactgatattggcattataaccttgtctcctggtatcaacaacgcccagacaaagccccaaatcatcattangagtcactaagcgcctnagggtttcattcgcttctctgctcaagtctgacaacacgctcctgacanctctggcctcgagctggagacgaggctagattatctgctgctcattangacagagtggtacgaccgtacgtaccggtaggtacgtcgggacggacggaccgacggtccgaccgtcgtacggtaccgaccgacccgacggtccgtcccgtccccg

SEQ ID NO: 303095 - DNA, 617 bp, Homo sapiens
  misc_feature: GZ8MTXP02JE8SA.9.71.G05.1.454.CMB.2.raw
  modified_base (279)..(279): a, c, t, g, unknown or other
  misc_feature (279)..(279): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccacactgatatggctattatacttgtctctgtatcaacacgccagacaacgccccanactcttaattatgagtacactaacgccgcctgtagggttctggtcgcttcctctcgcctacaagtcgtgcctaacgaccggtccctccctagaacctaactccgtcgttcgggccttacccgagttcgtacgaccgacggtacggaccttaggtaacctttattaccgtagtccaacgtcttacaattagtcgacgttacggtttcggtttcctttccgttaacgtaagttacgttacgttccggggaacgggtacggaaccgtacgggtccgtacggtaacccgttcgtaacgtacggtacgtaccgacccgtaacggtcccgtaccgtccccccgg

SEQ ID NO: 303096 - DNA, 556 bp, Homo sapiens
  misc_feature: GZ8MTXP02JQK50.9.71.G05.1.454.CMB.2.raw
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagagaggggggtggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaattatgaggtcactaagccggtccctcgtaggggtttctggtcnccttctctcgcctccaagtctggcaacacgccctcctcgacaatcctctcggctccagtctgaccgacgagctgattatacngcagctacatatgcgtagtttcggttcccttactttacgaagtacttaggttcgggacgggtacgggacctacgggtccgtacggaccgttccgtggacgttccgacgacccgtaacggccttcccccgg

SEQ ID NO: 303097 - DNA, 527 bp, Homo sapiens
  misc_feature: GZ8MTXP02GMY2J.9.71.G05.1.454.CMB.2.raw
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctaggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgaggtcactaagcggccctcaggggtttctggtcgcttcctctgcctccaagtctggcaacacggcctccctgacaatctctgggctccagtctgacgacgaggctgattattactgcagctcatangctagttgttcctntttacaaagtntagttcgggcggtaacgggaccaggctacggacccgttcctggacgtcgacgcccgaaggcctcgtccccccg

SEQ ID NO: 303098 - DNA, 552 bp, Homo sapiens
  misc_feature: GZ8MTXP02FPYNS.9.71.G05.1.454.CMB.2.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaaacgcccccacactcttaaatttatgaggtcactaacgcggccctcgtaggggtttctggtcgcttcctctcgcctccaagtctggcaaccacggccctcctagacaatctctgggtcctccagtctagacgacgaggctgattatactncagctacatangctaggtttcgttaccctttnttacaagtatacggttcgggacgggacggaccgacggtccgtcgtaccgtcgtggacgtacgaccgacccgacggtcctacccgtccccg

SEQ ID NO: 303099 - DNA, 548 bp, Homo sapiens
  misc_feature: GZ8MTXP02IC0FF.9.71.G05.1.454.CMB.2.raw
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataccttgtctcctgtatcaacaacgcccagacaaacgcccccacactcttaatttangaggtcactaagcgcctcgagggtttctggtcgcttcctctcgcctccagtctgcaaccacgcctcctgacatcnctggctccagtcngacgcgaggctgattatactgcagtctacatatgactgtttcgttcttnttacaagtacttacgttcgggaggtacggtaccgaacgggtctacggtaccccgttcgtaacggtaccgtacgacgacccccgaaaggtcccgtttcccgtacccccccgg

SEQ ID NO: 303100 - DNA, 555 bp, Homo sapiens
  misc_feature: GZ8MTXP02HE1IP.9.71.G05.1.454.CMB.2.raw
  modified_base (368)..(368): a, c, t, g, unknown or other
  misc_feature (368)..(368): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctctggtatcaacaacgcccagacaaacgacccccaaatcatcatttatgaggtcactaacgcggccctcgtaggggtttctattcgccttctctgctcaagtctgacaacncgcctcctgacatctctggctcgagctgacggacgaggctagtattatactgctgcctctatagtgacgagtagtggtcacctaccgttccggtaggttacgttccggggacgggaacgggaccgtaacgggtccgtaccgtaaccgtacggtccacggacccgtaacggccgtaccgtccccccgg

SEQ ID NO: 303101 - DNA, 547 bp, Homo sapiens
  misc_feature: GZ8MTXP02FU6OH.9.71.G05.1.454.CMB.2.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccacactcttaatttangaggtcactaagcggccctcgaggggtttcnggtcgcttcctctgcctcaagtctggcaacacggcctccctgacaatctctggcctcagtctgacgacgaggctgattattactgcagctcatatgctagttcggttcctctttacaagtattacgttcggcggtacgggacctagggcctacggacccgttcccgtgtaacgtccgaacgtccccgaaacgggtcccttacggtcccccccg

SEQ ID NO: 303102 - DNA, 543 bp, Homo sapiens
  misc_feature: GZ8MTXP02I2WBQ.9.71.G05.1.454.CMB.2.raw
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctggtatcaacacgcccagacaaacgcccccanactcttaatttatgaggtcactaagcgccctgaggggtttctggtcgtcttcctctcgcctccaagtctggcaacncgcctccctacactctctcggctccagtctgacgacgagctagtattatactgctagctacatatgctagttcgttcctctttcaagtattagttcgggacggtaggacccgtaggccttacgacccgttcctaggcgtacgacgtacccgaacggtcctaccgtcccccgttccgg

SEQ ID NO: 303103 - DNA, 552 bp, Homo sapiens
  misc_feature: GZ8MTXP02FROV0.9.71.G05.1.454.CMB.2.raw
  modified_base (291)..(291): a, c, t, g, unknown or other
  misc_feature (291)..(291): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgagtcactaagcggccctcgagggtttctggtcgcttcctctgcctcaagtctggcaacacggcctccctgacaatctctgggctcagtctgacgacgagctgattattactgcagctcatatgctagttggtttcctctttacaagtatacgtttcgggcggacgggtaacccagggccttacggaacccgttcccgtaaggtaacgtccacggaccccgaaaagggtccctaccggtcccccccgg

SEQ ID NO: 303104 - DNA, 563 bp, Homo sapiens
  misc_feature: GZ8MTXP02I4CE0.9.71.G05.1.454.CMB.2.raw
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgccccacactcttaatttatgaggtcactaagcggccctcaggggtttctggtccgcttctctcgcctccaagtctggacaacaccggcctccctgacatctctgggcctcagtctgacgacgagctgattattactgccagtctctatatgctagtttcggttccttctttacaagtattagttcggcggacggggaccaggcgttcgaccgttctcggacgttcacggcccaacgggtccttccggcccccgttcggtcctaccgttcgttcccgtttcccccgccccttaccgttctaacgg

SEQ ID NO: 303105 - DNA, 528 bp, Homo sapiens
  misc_feature: GZ8MTXP02GGNPX.9.71.G05.1.454.CMB.2.raw
  modified_base (425)..(425): a, c, t, g, unknown or other
  misc_feature (425)..(425): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaatttatgagtcactaagcggccctcaggggtttctggtcgcttcctctgcctccaagtctggcaacacggcctccctgacaatctcgtggcctcagtctgacgacgaggctgtattattactgcagctnatatcgcttagttcgtttccttctttacaagtatacgttcgggacggagggacccaggcctacgccgtcctaagacgtacacgcccgaagcctccgtcccccg

SEQ ID NO: 303106 - DNA, 531 bp, Homo sapiens
  misc_feature: GZ8MTXP02IX90F.9.71.G05.1.454.CMB.2.raw
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatatgggcattataaccttgtctcctggtatcaacaacgcccagacaaagcccccanactcttaatttatgagtcactaagcggccctcaggggtttctggtcgcttcctctgcctccaagtctgcaacacggcctccctgacaatctctggctcagtctgacgacgagctgattattactgcagctcatangctagtttcggttacctctttacaaagtattagttcggaccggaggggtacccaggtctcggacccgttccgtgacggtcacggcccgtaacggcctacgtcccccg

SEQ ID NO: 303107 - DNA, 634 bp, Homo sapiens
  misc_feature: GZ8MTXP02H16B0.9.71.G05.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccaccactgatattgggcattataacttgtctctggtatcaacaacgcccagacaaagccccacactctaattangaggtcactaacgcgccctctagggtttcnggtcgcttctctgcctcaagtctggcaacacccggcctcctgacaatctctggctcagtctgacgacagctgatttattaccgngactagtctactatagtcgtacgttaggtttccgtttaccttactttaagaaagttacgtttacgggttaccggggaccggggtaacgggtaaccgtacgggtacccgttaccggtaaccccggttcgttacggtaaccggtacccgaaccggaacccggtaacggtccccgtccccggtcccccgttacggtaacccgtacccgttcccgttccccggttacccccgtccccttaccgtaccgaacg

SEQ ID NO: 303108 - DNA, 538 bp, Homo sapiens
  misc_feature: GZ8MTXP02G9DVN.9.71.G05.1.454.CMB.2.raw
tcagtgatacgtctcacgaccggtgctcgatttagtgtcgtcgcaagagagaggggggggtcacaagaggcagcgctctcgagacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgccccacactcttaattatgagtcactaagccggcctcgaggggtttctggtcgccttctctcgcctcaagtctggcaacacgcctcctgacaatctcgtggctccagtctgacgacgagctgattatactgacagctcatatcgctagttcggttccttctttacaagtactacgttcgggacggtaagggaccctaggacctcggacccgttccgtagtacgttccgaacgaccccgtaaggtccttcccccgg

SEQ ID NO: 303109 - DNA, 554 bp, Homo sapiens
  misc_feature: GZ8MTXP02G1Q4M.9.71.G05.1.454.CMB.2.raw
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (463)..(463): a, c, t, g, unknown or other
  misc_feature (463)..(463): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcaccatctcctgcactggacccaccactgatattgggcattataaccttgtctctgtatcaacacgcccagacaaagcccccacactctttaatttatgaggtcactaagcggccctgaggggtttctggtcgtcttcctctcgccctccaagtctggccaaacncggccctcctgaacactctctgggcctccgagtctgacgacgaggctgattattactgcagctcatanagcttagttcgttcttctttacaagtnttacgttcgggacgggacggacccgtaggtccgtacgtacccgttcgttaacgaacgtccaacgcccgtaacgtccgtcccgtccccccgg

SEQ ID NO: 303110 - DNA, 556 bp, Homo sapiens
  misc_feature: GZ8MTXP02HIAVH.9.71.G05.1.454.CMB.2.raw
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
  modified_base (517)..(517): a, c, t, g, unknown or other
  misc_feature (517)..(517): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataaccttgtctcctggtatcaacaacgccagacaacgccccacactcttaacttatgagtcactaacgacgcctcgtagggttcgtgtcgtctcctctcgcctcagtctgcaacncgacctcctgacatctcgtgggcctccagtctagacgacgacggtctagtacttattacngcagtctcattatgccttagttcgtttcctactttacgaaagtacttaggtccgggacgggtaacggaccgcggtaccgtcgacccgttaccggnggtactaccgaccggaccgtacggtccgtacccgccccg

SEQ ID NO: 303111 - DNA, 550 bp, Homo sapiens
  misc_feature: GZ8MTXP02ILHMO.9.71.G05.1.454.CMB.2.raw
  modified_base (302)..(302): a, c, t, g, unknown or other
  misc_feature (302)..(302): n is a, c, g, or t
  modified_base (424)..(424): a, c, t, g, unknown or other
  misc_feature (424)..(424): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaacgccccacactcttaattangagtcactaagcgcctgagggtttctggtcgtcttcctctgcctcaagtctggcaacacgcctccctagacaatctcgtggcctcagtctgacgacgagctagattatatgctagctcatangctagttgttccttacgttacaagtattacgttccgggaggacggaaaccgacggtccgtacggtaacccgttccgtaaggtacgttacgacggtaccccgaacgggtcccttaccggtccccccg

SEQ ID NO: 303112 - DNA, 562 bp, Homo sapiens
  misc_feature: GZ8MTXP02GDZOI.9.71.G05.1.454.CMB.2.raw
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
tcagtgatacgtctcacgaccggtgctcgatttagtgtcgtcgcaagagagagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacattggtgctctaatcatgtctcctggtactataacagtccaggcaaacgcccccaaactcataatttatgatgtctttagaccggccctnagggtatttcttctcggttntcctgctcaagtcgtggaacncggcctcctgaccatctctgacttcagcctgaggacgtaggtgattacttcngctagttcagtacttcaacgtaaaccttccccgtggttcgggttgtcgggtacggacgggtacctagtcgcgtcgtaccgtctaggactcgacgccctaaggccgtccggcccccgttacggtcctaccttcccgtcgttcccccc

SEQ ID NO: 303113 - DNA, 545 bp, Homo sapiens
  misc_feature: GZ8MTXP02GUEJC.9.71.G05.1.454.CMB.2.raw
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcgtaggggtttctggtcgcttctctgcctccaagtctggcaacacccggcctccctgacaatctctgggctccagtctgacgacgaggctgattatactgcagctcatatgctagttcgttccttntttnaagtntagttcgggacggagggaccaggctcgaccgtctagacgtcacgacccaacggtcctccgcccccgtcggtcctaccttccgttccgttccccgcccttccgtactaaccgg

SEQ ID NO: 303114 - DNA, 529 bp, Homo sapiens
  misc_feature: GZ8MTXP02JOX63.9.71.G05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctggtatcaacaacgcccagacaaagcccccanactcttaatttangagtcactaagcgcctnagggtttctggtcgcttcctctgcctcaagtctggcacacggcctccngacatctctggctccagtctgacgacgaggctgattattactgcagctcatatgcagttcgttcctctttacaagattacgttaccgggaggacggtacccgtaaggtcctacggccgtacctggtacgtcgacggcccgaaacggtcctacggtccccccg

SEQ ID NO: 303115 - DNA, 527 bp, Homo sapiens
  misc_feature: GZ8MTXP02F1I2H.9.71.G05.1.454.CMB.2.raw
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacacgcccagacaaagcccccacactcttaatttatgaggtcactaagcggccctcgagggtttctggtcgcttctctgcctcaagtctggcaacaccgcctcctgacaatctctgggctccagtctgacgacgaggctgtattattactgcagctcatangctagtttcgttcctntttcaagtattagttcggcggtaggccaggctaggaccgttccgtgacgtcacgtcccaaggcctccgcccccttcggcctacgtcctccgtccccgcctcctcgtaacg

SEQ ID NO: 303116 - DNA, 553 bp, Homo sapiens
  misc_feature: GZ8MTXP02IM466.9.71.G05.1.454.CMB.2.raw
  modified_base (451)..(451): a, c, t, g, unknown or other
  misc_feature (451)..(451): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactggacccaccactgatattgggcattataaccttgtctcctggtatcaacaaccgccacgacaaacgcccccacactcttaatttactgaggtcactaagccggccctcgtacgggttctggtcgcttcctctgcctcagtctggcacacgcctcctgacaatctctggctccgagtctgacgacgaggctagattattactgcacgctctatatgactagtttcgtcctttnttacgaagtagttacgttacgggcgggacgggaacccgaggtactcggaaccccgttcgtaagacggttacacgacccgaaacggtcctaccgtccccccgg

SEQ ID NO: 303117 - DNA, 532 bp, Homo sapiens
  misc_feature: GZ8MTXP02GHPE9.9.71.G05.1.454.CMB.2.raw
  modified_base (290)..(290): a, c, t, g, unknown or other
  misc_feature (290)..(290): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaacgcccccanactcttaatttatgaggtcactaagccggccctcgaggggtttctggtcgcttcctctgcctcagtctggcaacncggcctcctgacatctcgtggctccagtctgacgacgaggctgattatacngcagctcatatgctagttcgttcctntttacaagtattacgttcgggacggacgggtaccagggtctcggacccgttccgtggacgtacacgaccccgaaggcctaccgtcccccg

SEQ ID NO: 303118 - DNA, 547 bp, Homo sapiens
  misc_feature: GZ8MTXP02ISGTS.9.71.G05.1.454.CMB.2.raw
  modified_base (321)..(321): a, c, t, g, unknown or other
  misc_feature (321)..(321): n is a, c, g, or t
  modified_base (413)..(413): a, c, t, g, unknown or other
  misc_feature (413)..(413): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatgggcattataaccttgtctcctggtatcaacacgcccagacaaacgcccccacactcttaatttatgaggtcactaagcggccctnacggggtttctggtcgtcttcctctgcctccaagtctgcaacacggccctccctgacaatctctgggctccagtctgacgacaggctgattnttactgcagctcatatgtctaggtttgttccttcgtttcaaagtcttaacgttcggggacggaggggacccagggtcctcggacccgttcgtcggtacgtccgacgacccgaacgggtcccttacgtcccccgg

SEQ ID NO: 303119 - DNA, 528 bp, Homo sapiens
  misc_feature: GZ8MTXP02FZFO7.9.71.G05.1.454.CMB.2.raw
  modified_base (333)..(333): a, c, t, g, unknown or other
  misc_feature (333)..(333): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaacgccccacactcttaatttatgaggtcactaagccggccctcgagggtttcnggtcgcttctctgccacagtctggcacacggcctcctgacatctctggctcagtctgacgacgaggctgattatactgcagctcatatgctagttcgttctcttacaagtatacgttcggacggacgggtacccaaggtctacgaccggttcctaagggtactacgacgtcccgaaacgggcctaccgtcccccg

SEQ ID NO: 303120 - DNA, 536 bp, Homo sapiens
  misc_feature: GZ8MTXP02I28H9.9.71.G05.1.454.CMB.2.raw
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagtggctattataaccttgtctcctgtatcaacaacgccagacaaacgcccccanactcttaattatgagtcataagcgccctgagggtttctggtcgtcttcctctcgcctactaagtctgcaacacggccctccngacatctcgnggctcgagtctgacgcgagntcgattatactgcatcctnagtntacgctagtttcggttacttcctttaagaagtacgttacggtcggacggtacggacgtacgtcgtacgtaccgtcgtgtacgacgaccgaccgacgtccgtaccgtcccg

SEQ ID NO: 303121 - DNA, 560 bp, Homo sapiens
  misc_feature: GZ8MTXP02HXRG8.9.71.G05.1.454.CMB.2.raw
  modified_base (289)..(289): a, c, t, g, unknown or other
  misc_feature (289)..(289): n is a, c, g, or t
  modified_base (376)..(376): a, c, t, g, unknown or other
  misc_feature (376)..(376): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaaacgccagacaaaagccccanactcttaatttatgaggtcactaagcggcctcaggggtttctggtcgtcttcctctgctccaagtctggcaaacacggcctccctanacaatctcgtggcctcagtctgacgacgagctagtattattactgtcagtactactataatagtacgtacgttcggtttccgttactttactaaagtaagttaacgttacggtacgggacgggacggacggacgtacgtaccgtccgtcgtacgtacgacgaccgaacggacgtaccgtccccg

SEQ ID NO: 303122 - DNA, 557 bp, Homo sapiens
  misc_feature: GZ8MTXP02IFH9V.9.71.G05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (489)..(489): a, c, t, g, unknown or other
  misc_feature (489)..(489): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctctgtatcaacacgcccagacaaacgcccccanactcttaatttangaggtcactaagccggccctcgtacggggtttctggtcgcttcctctgcctcagtctggcacncgcctcctgacaatctctggctcccgatctgacgacgaggctgattattactgacagctacgattatgcctagtttcgtaccttcgtttacaaagtataacgttcgggacggacggggaaaccncgggtcctacggaccccgttacctggacgttaccgacggaccccaaagggtcccttaccggccccccg

SEQ ID NO: 303123 - DNA, 531 bp, Homo sapiens
  misc_feature: GZ8MTXP02IOJF9.9.71.G05.1.454.CMB.2.raw
  modified_base (117)..(117): a, c, t, g, unknown or other
  misc_feature (117)..(117): n is a, c, g, or t
  modified_base (268)..(268): a, c, t, g, unknown or other
  misc_feature (268)..(268): n is a, c, g, or t
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagaggggggggtcacaagaggcagcgctctcgggacgtctccaccatggcctgggctctgctgctccncacccctcctcactcaggacacagggtcctgggccctgtctgccctgactcagcctgcctccgtgtctgggtctcctggacagtcgatcaccatctcctgcactgacccacactgatatgggcattataccttgtctcctgtatcaacacnccagacaacgcccccacactcttaatttatgaggtcaactaagccggccctcgtaggggtttctcggtcgcttcctctcgcctcagtctcgcaacgacgcctccctgacatctcgtggcctcagtctgacgcgagtctanagttatactgcacgtctacagtatgctagttcgttaccttnttacaagtattacgtggacggaggacccgaggccgtcgacccgttcgtgacgtcgacgtacccgaaggtcctccgtcccccg

SEQ ID NO: 303124 - DNA, 507 bp, Homo sapiens
  misc_feature: GZ8MTXP02FND28.9.71.G05.1.454.CMB.2.raw
  modified_base (288)..(288): a, c, t, g, unknown or other
  misc_feature (288)..(288): n is a, c, g, or t
  modified_base (482)..(482): a, c, t, g, unknown or other
  misc_feature (482)..(482): n is a, c, g, or t
tcagtgatacgtctcacgaccggtgctcgatttagtgtcgtcgcaagagagagggggggtcacaagaggcagcgctctcgggaagtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaagcccccanactcttaatttatgaggtcactaagcggccctcgagggtttctggtcgcttctctgcctcagtctggcaacacggcctcctgacaatctctggctcatctgacgcgagctgattattactgcagctacatatcgactagttcggttacctctttacgaagtatagttcggcgacgggaccaggctcgaccgtcngagtcacggccaggctcgtcccccg

SEQ ID NO: 303125 - DNA, 584 bp, Homo sapiens
  misc_feature: GZ8MTXP02F1ADP.9.71.G05.1.454.CMB.2.raw
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggctattataaccttgtctcctggtatcaacaacgcccagacaaacgcccccacactcttaatttatgaggtcactaagccgccctcgaggggtttctgtcgtctcctctgcctcaagtctggcaacacggcctcccngacaatctntggcctcatctgacgacgaggctgattatactgcagctcatatgtactagtttcggttaccctctttacgaaagtacgttaacgtttccggggacgggtaacgggaccgtacgggtacctccggtaacccggttcccttaagggaccgttaccgaccggtaccccgtaaacgggcccttacccggttcccccccgg

SEQ ID NO: 303126 - DNA, 543 bp, Homo sapiens
  misc_feature: GZ8MTXP02GRVUZ.9.71.G05.1.454.CMB.2.raw
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactcggacccacactgatattggctattataacttgtctctgtatacaacaacgccagacaaacgccccatactcttaattangagtacactaacgccgcctcgtagggtttctggtcgtcttccctctcgcctccaagtctggccaacaccggcctcctgacaatctcgtggcctcagtcngacgacgaggtctagtattactacgtgacagtctacattatcgcttaggttcgttcctctttacaagtagtacgtcgggacggacggtaccgacggtccgtacgtccgtcgtgtacgacgaccgaccgacgcctcccgtcccg

SEQ ID NO: 303127 - DNA, 532 bp, Homo sapiens
  misc_feature: GZ8MTXP02HKE9N.9.71.G05.1.454.CMB.2.raw
  modified_base (503)..(503): a, c, t, g, unknown or other
  misc_feature (503)..(503): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgcccccacactcttaattactgagtcactaagcgccctcagggtttctggtcgcttcctctgcctcaagtctggcaacacggcctccctgacaatctctcggctccagtctgacgacgaggctgacttatactgcagctcatagtgctagttcgttccttactttcaaaagtacttacgttcggacggtagggaccctaggctcggtaccgtccgtaagngtcacgacccgaaggccttccggcccccg

SEQ ID NO: 303128 - DNA, 580 bp, Homo sapiens
  misc_feature: GZ8MTXP02GWO62.9.71.G05.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctgtatcaacaacgccagacaaacgcccccanactcttaattatgaggtcactaagcggccctcgtacggggtttctggtcgtcttcctctcgcctcaagtctggcaaccacggcctccctgacatctctggcctcagtctgacgcgaggctgattatactgcagctatactagtcgtactacgtttcggttcccttactttacgaagtacttaacggtttcgggacgggtaacgggtacccgtagggtcccgtacggtaacccgttccgtaaggacgttaccgaccggacccgtaaacgggtccctacccggtcccccccg

SEQ ID NO: 303129 - DNA, 524 bp, Homo sapiens
  misc_feature: GZ8MTXP02G29JU.9.71.G05.1.454.CMB.2.raw
  modified_base (287)..(287): a, c, t, g, unknown or other
  misc_feature (287)..(287): n is a, c, g, or t
  modified_base (415)..(415): a, c, t, g, unknown or other
  misc_feature (415)..(415): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataacttgtctcctgtatcaacaacgccagacaaacgccccanactcttaatttatgagtcactaagcggaccctcaggggtttctggtcgtcttccgtctgcctaccaagtctggcacacggcctccctgacatctctggctcatctgacgacgagctgattattactgnagctcatatgctagttgttccttctttacaaagtactagttcgggaggacgggaccgacggcttcgaaccggttcctggacgtacgacgacccaaggcctacgcccccg

SEQ ID NO: 303130 - DNA, 525 bp, Homo sapiens
  misc_feature: GZ8MTXP02I4VF3.9.71.G05.1.454.CMB.2.raw
  modified_base (263)..(263): a, c, t, g, unknown or other
  misc_feature (263)..(263): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgcccagacaaagccccanactcttaatttatgaggtcactaagcggccctgagggtttctggtcgtttctctgcctcaagtctggcaacacggcccctccctgacaatctctgggcctccagtctgacgacgaggctgattattactgcagtcncatatgacagtttgtcctntttcaagtntagttcggcgagggccagggtctggaccgtctgagtcacgccgaagtctcgccccctcggttaccncgtccgtccgtccctacctccgtacacgtacg

SEQ ID NO: 303131 - DNA, 561 bp, Homo sapiens
  misc_feature: GZ8MTXP02FM653.9.71.G05.1.454.CMB.2.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggctattataaccttgtctcctgtatcaacaacgcccagacaaagcccccanactcttaatttatgagtcactaagcgccctcgtaggggtttcnggtcgtcttcctctcgcctcaagtctcggcaacacggcctccctgacaactctcgtggcctccgagtctgacgacgaggctgatttattactgcagctacatatgctagtttcgtttaccttcttacgaagtatttacggttccgggcgggaacgggtaccgacgggtctacggtacccgtccgtgtacgtcaccggcccctaaggtcccgtccgtcccccccgg

SEQ ID NO: 303132 - DNA, 564 bp, Homo sapiens
  misc_feature: GZ8MTXP02HZLVF.9.71.G05.1.454.CMB.2.raw
  modified_base (404)..(404): a, c, t, g, unknown or other
  misc_feature (404)..(404): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctctgtatcaacacgccagacaacgccccacactacttaatttatgagtcactaagccggccctcgtagggtttctggttcgtttctctcgcctcaagtctggacacaccggcccctccctgacatctcgtgggctcagtctgacgacgagctagattatactgcagtctcattangtacttagttcgtttccttctttacgaagtattacggttcgggacgggacgggacagggctacggacccgttcctagacgtacgaccgtacccgaaggccctccgcccccttcggtcctaacctccgttacttcccccacccttccgtacaacggtaccg

SEQ ID NO: 303133 - DNA, 568 bp, Homo sapiens
  misc_feature: GZ8MTXP02IPV4G.9.71.G05.1.454.CMB.2.raw
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (539)..(539): a, c, t, g, unknown or other
  misc_feature (539)..(539): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactggacccacactgatattgggctattataacctgtctcctggtatcaacaacgcccagacaaacgcccccanactcttaatttatgagtcactaacgcgcctcaggggttctggtcgcttcctctncctcaagtctgcaacacgccctcctagacaaatctctgggctccgagtctagacgtacggaggcttacggatttaacttacgtgtccaaggtctacatatgacttaggtttcggttcctttacttacgaaagtacttacgttcgggtacgggacggtaaccgacgggtccacggtaacccgtctaaggtcgtacncgtaacccgaggtccctccggtcccccgg

SEQ ID NO: 303134 - DNA, 500 bp, Homo sapiens
  misc_feature: GZ8MTXP02GW2GI.9.71.G05.1.454.CMB.2.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagtgatacgtctcacgaccggtgctcgatttagtgtcgtcgcaagagagagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaagcccccanactcttaatttatgaggtcactaaagcggccctnaggggtttctggtcgcttcctctgcctccaagtctggcaacacggcctccctgacaatctctggcctcagtctgacacgagctgattatactgcagctcatatgctagttgttcctntttcaagtatattcggcggaggaccgagctacgaccgtcngacgtcacgccacgctcgccccg

SEQ ID NO: 303135 - DNA, 574 bp, Homo sapiens
  misc_feature: GZ8MTXP02HV881.9.71.G05.1.454.CMB.2.raw
  modified_base (288)..(288): a, c, t, g, unknown or other
  misc_feature (288)..(288): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagccccanactcttaattatgaggtcactaagcgcctcgagggtttctggtcgcttccgtctgcctccaagtctggcaacacggcctccctgacaatctctggctcagtctgacgacgagctgattattactgcagtctcatatgctagtttcggttccttcgtttacaaagtagttaagtttcggggacggacgggaccgtaagggtccgttacggtaaccccggttccgtaacggtaaccggttacgtaaccggaccccgtaaaacgggcccgtttaaccggtcccccccgg

SEQ ID NO: 303136 - DNA, 550 bp, Homo sapiens
  misc_feature: GZ8MTXP02G2RJX.9.71.G05.1.454.CMB.2.raw
  modified_base (288)..(288): a, c, t, g, unknown or other
  misc_feature (288)..(288): n is a, c, g, or t
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
  modified_base (516)..(516): a, c, t, g, unknown or other
  misc_feature (516)..(516): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactggacccacactgatattggcattataaccttgtctcctggtatcaacaacgcccagacaaagcccccanactcttaagttatgagtcactaagcggccctcgtagggtttctggtcgtcttccgtctcgcctcaagtctggcctacacggccctccctagactaatccctcgtggccttcagttcngaacgcgaggctgacttattactgctagctctaatntcgctagtttcggttccctttnttacgaagtacgttacgtacggacggacggacgtacggtcgtacgtccgtcgngtacgtcgacgaccgtacgtcccgtccgtccccg

SEQ ID NO: 303137 - DNA, 516 bp, Homo sapiens
  misc_feature: GZ8MTXP02GTSNP.9.71.G05.1.454.CMB.2.raw
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (383)..(383): a, c, t, g, unknown or other
  misc_feature (383)..(383): n is a, c, g, or t
  modified_base (514)..(514): a, c, t, g, unknown or other
  misc_feature (514)..(514): n is a, c, g, or t
tcagtgatacgtctcacgaccggtgctcgatttagtgtcgtcgcaagagagaggggctttgcctgggctctgctgctcctcacccgtcctcactcaggacacagggtcctgggccctgtctgccctgactcagcctgcctccgtgtctgggtctcctggacagtcgatcaccatctcctgcactggacccaccactgatattggcattataaccttgtctcctggtatcaacacgccagacaaacgccccacactcttaattangaggtcactaagcggccctnagggtttctggtcgtcttctctgcctccaagtctggcaacgacgcctcctgacccatctctgggctcagtctgacgacgagctgattatactgcagctnatatgctagttgttcctcgtttacaagtatagttcgggaggagggaccaggcttcggaccgtctgagtcgacgccgacgcgtcgcccgtccgtcgtactctcgttcccgtccctcctcacgacgtactacncg

SEQ ID NO: 303138 - DNA, 519 bp, Homo sapiens
  misc_feature: GZ8MTXP02FQQY7.9.71.G05.1.454.CMB.2.raw
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
  modified_base (487)..(487): a, c, t, g, unknown or other
  misc_feature (487)..(487): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcatatacttgtctctgtatcaacacgccagacaaagcccccanactcttaatttatgaggtcactaagcggccctcgtaggggtttctggtcgtcttcctctgcctcaagtctggcaacacggcctcccngacatctctgggctcagtctgacgacgaggctgattacgttactgcagctcatangctagttgttcctcttacaagtatacgttcgggcggtacggacccagggcctacggaccgtcgngtaacgtcacgcccgaaggcctacgtcccccg

SEQ ID NO: 303139 - DNA, 523 bp, Homo sapiens
  misc_feature: GZ8MTXP02GQA9G.9.71.G05.1.454.CMB.2.raw
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataaccttgtctcctggtatcaacaacgcccagacaaacgcccccacactcttaatttatgagtcactaagcgcctcagggtttcctggtcgcttctctgcctccaagtctggcaacacggcctccctgacaatctctggctccagtctgacgacgagctgattatactgacngctcatatgctgttcggttctctttaanaagtactacgtcggacggacggacgacgtcgtacgtaccgtcgtaagtacgacgacgaccgacggtcctaccgtccccg

SEQ ID NO: 303140 - DNA, 514 bp, Homo sapiens
  misc_feature: GZ8MTXP02GNDAJ.9.71.G05.1.454.CMB.2.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaaccagcagtgattggttgggagttatggaccttgtctcctggtaccaacngcacccaggcaaacgccccaaactcatcatttangaggtcactaagcggcctgtagggttctattccgcttctctggctccagtctgacaacacgcctcngacatctcgtggctcgagctggacgacgagctgattaactntcgcttgctnaattgcganagtgtgtacacgtcgtcggtagtacgtcgggacggtacgaccgtaggtacgaaccgtacgtacgcgacgaccgacgccgtccg

SEQ ID NO: 303141 - DNA, 522 bp, Homo sapiens
  misc_feature: GZ8MTXP02G05JZ.9.71.G05.1.454.CMB.2.raw
  modified_base (287)..(287): a, c, t, g, unknown or other
  misc_feature (287)..(287): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactgacccacactgatattggctattataaccttgtctcctgtatcaacaacgccagacaacgcccccanactcttaattatgagtcactaagcgcctcgacgggtttctggtcgtcttcctctcgcctcagtctggcaacacggccctcccgtgacaactctcgtcggctcagtctgacgacgngctgattatacngacagtctcatnagctagttcgttctatattacaagtatacgttcgggacggagggaccaggtctcgtaccgtccgtgacgtacacgtacccgaacggtcctccccgg

SEQ ID NO: 303142 - DNA, 743 bp, Homo sapiens
  misc_feature: GZ8MTXP02GZ6TI.9.71.G05.1.454.CMB.2.raw
  modified_base (277)..(277): a, c, t, g, unknown or other
  misc_feature (277)..(277): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcacatctcctgcactcgacccacactgatagtggctattatacttgtctctgtatacaacacgccagacaacnccccactactacttaacttatagacggtactaacgtaacggcccggtacccgttacggtacggggtttccgttcgggtccggttcctttccccgttccgttcggtaccccttaccgtaaacggttccgttacgggacccgaaacccgtacccgggtacccccttacccccggtacgtaaacctaaaccttcccttaccgggttcggggtacccttacccgtacggttaccttaccggggaaccggtacccggtagggtacctaaggttaaatttacgtttaacctcggtactaagtcctactaattacgtgtacgttacggtttacgtttccttactttacgtaaagtacgttacggtttacgggaccgggttacggggaacccgaggggtacccgtacggtaacccgtcgttaacggaccgttcgaaacccggaccgtaacgggcccttacccggtaccccccgg

SEQ ID NO: 303143 - DNA, 609 bp, Homo sapiens
  misc_feature: GZ8MTXP02GUI4R.9.71.G05.1.454.CMB.2.raw
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgcccagacaaacgcccccacactcttaatttatgagtcactaagccggccctcgaggggtttctggtcgcttctctgcctcaagtctggcaacncccggccctcctgacaatctcgtcgggctccgagtccngacgacgaggctgaatttatactgnagctacatatgctagtttcggttcccttatttacaaagtactaaggttcggacgggacgggaccgtacggtctacggaaccccgttcgttacggacggttaccaacggaccccgtaaacgggtccttacccgggccccccttacggggtccctaacccgttaccgttaccccgttcccccgtaaccccgtcccttacgtaaacccgg

SEQ ID NO: 303144 - DNA, 528 bp, Homo sapiens
  misc_feature: GZ8MTXP02FYNO4.9.71.G05.1.454.CMB.2.raw
  modified_base (286)..(286): a, c, t, g, unknown or other
  misc_feature (286)..(286): n is a, c, g, or t
  modified_base (328)..(328): a, c, t, g, unknown or other
  misc_feature (328)..(328): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataacttgtctctgtatcaacaacgccagacaaacgccccanactcttaatttatgagtcactaagccgcctcgtagggtttcnggtcgtcttcctctcgcctcaagtctgcaacacggcctcctgacatctgtggctcagtcagacgacgaggtctagattactactgcagctacatatgactagttcgttcctctttacaaagtatacgttcgggacggacggaccgtacggtctacgaccgtccgtaagacgtcgacgacccaacggtctccgtacccccg

SEQ ID NO: 303145 - DNA, 527 bp, Homo sapiens
  misc_feature: GZ8MTXP02FIAKI.9.71.G05.1.454.CMB.2.raw
  modified_base (335)..(335): a, c, t, g, unknown or other
  misc_feature (335)..(335): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtatcaacaacgcccagacaaagcccccacactcttaatttatgaggtcactaaagcggccctcgtaggggtttcnggtcgcttcctctgcctccaagtctggcaacacggcctccctgacaatctctgggcctccagtctgacgacgaggctgattattactgcagctcatatgctagttcggttcctacttacaagtataacgttcgggcgggtaggaccaggctacgacccgtccgaagtcacgccgaaggccacgccccctcgg

SEQ ID NO: 303146 - DNA, 521 bp, Homo sapiens
  misc_feature: GZ8MTXP02FV7W4.9.71.G05.1.454.CMB.2.raw
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattggcattataacttgtctcctgatcacacgccagacaaacgcccccacactcttaatttactgacggtcactaagcggccctcgtaggggtttcnggtcgcttcctctcgctcaagtctgcacacgcctccngacatctcncggctcagctgacgcgagctgattatactgcagctcatatgctagttcgttctcttacagtactacgttcggacgggtacggacctaggctacggcccgtcctaagtacgtacgacggcccgtaacggcctacggtccccccg

SEQ ID NO: 303147 - DNA, 541 bp, Homo sapiens
  misc_feature: GZ8MTXP02G7LRH.9.71.G05.1.454.CMB.2.raw
  modified_base (290)..(290): a, c, t, g, unknown or other
  misc_feature (290)..(290): n is a, c, g, or t
  modified_base (373)..(373): a, c, t, g, unknown or other
  misc_feature (373)..(373): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgcccccanactcttaatttatgagtcaactaaagccggccctcgtaggggtttctcggtcgtcttccctctcgcctccaagtctggcaacncgcctcctgacatctctggcctcagtctgacgacgaggctagattatactgcagcttacatangctagttcgttctntttcaagtatacgttcggcggtacgggacacggtcgtcgaaccgttccgtaagtacgtacgacgacccgaacggtccgtacgttcccccgg

SEQ ID NO: 303148 - DNA, 520 bp, Homo sapiens
  misc_feature: GZ8MTXP02J2B59.9.71.G05.1.454.CMB.2.raw
  modified_base (290)..(290): a, c, t, g, unknown or other
  misc_feature (290)..(290): n is a, c, g, or t
  modified_base (493)..(493): a, c, t, g, unknown or other
  misc_feature (493)..(493): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgagtcactaagcgccctcaggggtttctggtcgcttcctctgcctcagtctggcaacacggcctcctgacaatctactggctccagtctgacgacgaggctagattatactgaagctcatatgctagtttggtaccttctttacaagtatagtttcggacggtagggacccagggctcgaccgtctaggngtcacgcccaagcctacgccccctcgg

SEQ ID NO: 303149 - DNA, 547 bp, Homo sapiens
  misc_feature: GZ8MTXP02GFMLS.9.71.G05.1.454.CMB.2.raw
  modified_base (404)..(404): a, c, t, g, unknown or other
  misc_feature (404)..(404): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcgagggtttctggtcgcttctctgcctccaagtctggcaacaccggcctccctgacaatctctgggctccagtctgacgacgaggctgattatactgcagctcatangctagttgtccttctttcaagtatagttcggcggtaggaccaggctgacccgttccgtgacgtcacgacccgaaggccttccgcccccgttcggtccgtaccttccgttccggttcccccgccccttcccgttacaaacccgg

SEQ ID NO: 303150 - DNA, 617 bp, Homo sapiens
  misc_feature: GZ8MTXP02JITJS.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacaacgaccagacaaacgcccccacactcttaattatgaggtcactaagccgcctcgtacgggtttctggtcgtcttccgtctgccctaccaacgtctggccaaaccgaccggcccttacccgtgaacctaaattcctccgtgggtcccttaccgcgttcgtaggtaccgacggagggtcttagatttacttacgcgtacacgtctacgtattatcgtactacggtttcggttacccttcgtttacgaagtattaacggttcggacgggtacgggaccgacgggtacctacggtacccttcgtaagacgttaccgacgtacccggaacgtcccgtaccggtcccccccgg

SEQ ID NO: 303151 - DNA, 533 bp, Homo sapiens
  misc_feature: GZ8MTXP02FN0TW.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtatcaacaacgccagacaaacgccccacactcttaatttatgaggtacactaagcgccctgtagggtttctggtcgtcttcctctcgcctcaagtctggcaacacggcctcctgactaatctctggcctcagtctgacgacgaggctagattatactgcagctcatatgctagttcgttcttctttacaagtattacgttcgggacggtacgggaccacggctacgaccgtccgtaagacgtacgacgacccgaacggtcctaccgtcccccg

SEQ ID NO: 303152 - DNA, 539 bp, Homo sapiens
  misc_feature: GZ8MTXP02IF7EW.9.71.G05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (408)..(409): a, c, t, g, unknown or other
  misc_feature (408)..(409): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacacgccagacaaagcccccanactcttaatttangaggtcactaagccgccctcgaggggtttctggtcgcttcctctgccacagtctgcacncgcctcctgacatctctggctcagtctgacgcgagctgattattacnncagctcatatgctaggtttcgttccttntttacaagtcttaacgttcgggacggacggggacccagggtcctacggaccccgttccgaagtacgttacgacggtaccccgaacggtcctccgtccccccg

SEQ ID NO: 303153 - DNA, 529 bp, Homo sapiens
  misc_feature: GZ8MTXP02JZW5U.9.71.G05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgcccagacaaagcccccanactcttaatttangaggtcactaacgcggccctgaggggtttctggtcgcttcctctgcctcaagtctggcaacacggcctcctgacaatctctgggctccgaggctgaggacgnggactgacttatactgctgctcattactgcagatggtnactacgtcccgtaggtacgttcgggcgggaagggaccaagggttcgaccgttcgtaaggcacggcccaaggcctcggccccctcgg

SEQ ID NO: 303154 - DNA, 515 bp, Homo sapiens
  misc_feature: GZ8MTXP02FOQ64.9.71.G05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccanactcttaatttangagtcactaancggcctcaggggtttctggtcgcttctctcgctccaagtctggcaacacggcctccctgaacaaatctctgggctcccagtctgacgacgaggctgattatactgnagcncatatgctagttgtcctnttacaagatagttcggacggtagggaccaggctacgccgtcctaagacgtcacgcccaacggctacgcccccg

SEQ ID NO: 303155 - DNA, 822 bp, Homo sapiens
  misc_feature: GZ8MTXP02H789D.9.71.G05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgattagtggctattataaccttgtctctgtatcaacacgccagacaacgccccanactacttattangagtcactacgcgcctgagggttctggtcgtcttcctactcgtcctacgtaagttcgttacgggaccaaaccgtaacccggtccccttacccgtacgtaaccctaaactttccctaacccggttcgggggccctttaacccgtaacggtttacccgtagggtaaacccggaaccgggtaacgggttacccttaagggtttaaacttttaaacgtttaaaccgttcggacccgtaaacggtttacccttaccggtaaattacggtttacggaaaccccgtttagggggtttttacccgggttttcccctttttaacccttttaaaggtaaaacgtttaacccggttttaaaggtttaccccgggggaacgggggttaaacccggggaaacccggtaacggggttcccggttaaaccgggtaccccgggtttaccgtaaccggggttaaccggttacccgaaaacccggggttacccccgaaaacccgggggtccccttttaacccccggtacccccccccggg

SEQ ID NO: 303156 - DNA, 577 bp, Homo sapiens
  misc_feature: GZ8MTXP02HNAXO.9.71.G05.1.454.CMB.2.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcacccctcctcactcaggacacagggtcctgggccctgtctgccctgactcagcctgcctccgtgtctgggtctcctggacagtcgatcaccatctcctgcactggacccacactgatagttgggctattataaccttgtctctgtatcaacaacgccagacaacnccccacactcttaattngagtcactagcgcctgtagggttctggtcgtctcctctgcctcatctggcacgacgccnccagactatctgtcggtcctcgagtcctaggacgtacgaggtctagtattactttaacgnacacgtctactaggttatcgaccgttaggttcgtttaccttcgtttacaaagtacttaacggttccggacggggtaacggacccgtaggtccgtcgtaacccgtccgttaaggacgttaaccgacggacccgaacggtcccgtttcccgtccccccgg

SEQ ID NO: 303157 - DNA, 590 bp, Homo sapiens
  misc_feature: GZ8MTXP02JJG7R.9.71.G05.1.454.CMB.2.raw
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccacactgatatggcattataacttgtctcctgtatcaacaacgccagacaacncccccanactcttaattanagagtcactaacgcgcctcgtagggttctgtcgtcttcctctgccctacagtctgccaacacggcctccgagacatctcgnggtcctcgagtctacgacgcgacggctagtacttagttactcgacgtacgtctactaattactcgtccgttaggtttccggtttaccttactttacgtaaagtacgtttaacggttcggacgggtacgggaccaacggtcctaaccggtcccgttaccgtggtaaccgtccggaaccgtacccgtaaaccggccgtaccccggttccccccgg

SEQ ID NO: 303158 - DNA, 549 bp, Homo sapiens
  misc_feature: GZ8MTXP02J05MO.9.71.G05.1.454.CMB.2.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattataccttgtctctgtatcaacacgccagacaacgccccanactcttaattangaggtcactaagcgcctcagggtttctggtcncttcctctgcctcaagtctggccaacgacggcctcctgacatctcgtggctcagtctgacgacgagctgattattactgcagctacattatgtactacgtttcggtttaccttctttacgtaagtacttaggttcgggacgggtaacgggacccgagggtcctacgacccgttccgtgtacgtaccgaccgttacccggaacggtccctacccggtcccccg

SEQ ID NO: 303159 - DNA, 569 bp, Homo sapiens
  misc_feature: GZ8MTXP02JW700.9.71.G05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactggacccaccactgatattgggctattataaccttgtctcctgtatcaacacgccagacaacgccccanactcttaatttangagtcactaagcgcctnagggttctggtctctcctcngcctcatctgcacacgcctcctnacatctcgtggacctccgagtctgacgacgaggctagtattattacgngacncgctatatatcgtacgttgtttccgttccttacgttactaagtacgttacggttacggggacgggtacgggaaccgtacgggtaccgtaccggtaacccgttcggtaacgtacggtaccgaccggaccccgtacggtcccgtacccgtcccccgg

SEQ ID NO: 303160 - DNA, 597 bp, Homo sapiens
  misc_feature: GZ8MTXP02GWK0A.9.71.G05.1.454.CMB.2.raw
  modified_base (290)..(290): a, c, t, g, unknown or other
  misc_feature (290)..(290): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggctattataacttgtctcctgtatcaacaacgccagacaacgccccanactacttaattatgagtcactaagcggccctgtacgggtttctggtcgtcttcctctcgcctacagtctgcaacacggtcctcctgactaactctcgtggcctcgagtctgacgacgagctagtacttagttactgactacgtctanaacttagtcgtacgttaacggtttcggttaccctttcgtttacgtaaaagtacgtttaacgtccggggtacgggaccggggtaaccgacgggtccgtacggtacccgttaccgtaaggtacgtaccgaccggacccgaacggtccctcccggtcccccgg

SEQ ID NO: 303161 - DNA, 540 bp, Homo sapiens
  misc_feature: GZ8MTXP02H2KSL.9.71.G05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcgacccacactgatattgggcattataaccttgtctcctggtatcaacaacgcccagacaaacgcccccanactcttaatttangaggtcactaagcggccctacgaggggtttctggtcgtcttcctctcgcctccaagtctggccaacacggccctccctgacaatctctggctcagtctgacgacgngctgattatactgcagctcatatgctagtttgttccttctttacaagtattacgttcgggtcgggacggaccgaacggccgtcgtaccgtccgtaagacgtacgacgcccgaaacggtcctacgtcccccg

SEQ ID NO: 303162 - DNA, 622 bp, Homo sapiens
  misc_feature: GZ8MTXP02GW051.9.71.G05.1.454.CMB.2.raw
  modified_base (289)..(289): a, c, t, g, unknown or other
  misc_feature (289)..(289): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattggctattataaccttgtctcctgtatcaacacgccagacaacgcccccanactacttaattatgagtcaactaagccggtcctcgtacgggtttctggtcgtcttcctctcgcctcagtctgcacacgcctcctagactactctcgtcggcctcacgtctcgacgacggagtcgtagtattacttacgtcgtacacgtctactagttacgtcgtacgttacggtttcggtttcccttactttacgtaaacgttacgttacggtttccggggacgggtaacggggtacccgtaaacggggttccgtaccgggtaccccgtcgttaaggtaaccgtacccgtacggacccccgaaacgggtccccgttacccggtcccccccggg

SEQ ID NO: 303163 - DNA, 592 bp, Homo sapiens
  misc_feature: GZ8MTXP02JSP1U.9.71.G05.1.454.CMB.2.raw
  modified_base (291)..(291): a, c, t, g, unknown or other
  misc_feature (291)..(291): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgatcaccatctcctgcactcggacccaccactgattagttgggctattataaccttgtctcgtgtatcaacaacgccagacaaacgccccanactcttaatttatgaggtcactaagccggccctagtaggggtttctggtccgtcttcctctcgcctacctaagtcgtacggccaaaccacggtccccttcccgagacctaaatccttccgtgggcctaccgaacgttctagacgacgaggtctagtactttataccgtgacacgtctactataagtcgtcgtacggtttcgttccttacgtttacaagtacttaacgttcgggacgggacggtaccaggtcctacggaccgttccgaagcgtacgacgccgaacggcgtacccgtcccccg

SEQ ID NO: 303164 - DNA, 548 bp, Homo sapiens
  misc_feature: GZ8MTXP02FNENV.9.71.G05.1.454.CMB.2.raw
  modified_base (301)..(301): a, c, t, g, unknown or other
  misc_feature (301)..(301): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagccccacactcttaatttangaggtcactaagcggccctgacggggtttctggtcgcttcctctcgcctcaagtctggcaacacggcctccctgacaatctctggctcagtctgacgacgaggctgattattactgcagctcatatgctagtttcgttcctctttcaaagtacttaacgttcggggacggtaacggggaccctaagggccgttacggaacccgttcgtaacgtacgtcaacggcccgaagggcccttacgccccccg

SEQ ID NO: 303165 - DNA, 551 bp, Homo sapiens
  misc_feature: GZ8MTXP02FFC53.9.71.G05.1.454.CMB.2.raw
  modified_base (330)..(330): a, c, t, g, unknown or other
  misc_feature (330)..(330): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagccccacactctaatttatgaggtcactaagcggccctcaggggtttcnggtcgcttcctctgcctccaagtctggcaacacggcctccctgacaaatctctgggcctcgagtctagacgacggaggctgaatttattacgtcgacacgtctactaatatcgactaggtttcggttccttcgtttacaagtacttacgttcgggcggaacggtaccgacgggtctacggacccgtccgtgacgtcacgcccaaaggcctcggtccccccg

SEQ ID NO: 303166 - DNA, 520 bp, Homo sapiens
  misc_feature: GZ8MTXP02IRUET.9.71.G05.1.454.CMB.2.raw
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctgtatcaacacgccagacaaacgcccccanactctttaatttatgagtcataacgcgccctnaggggtttctggtcgcttctctgcctcaagtctggacncgcctcctgacatctctcggctccagtctgacgacgagtctgattatactgactgctnactatcgntagttcggttctctttcaaagtnttacgttcgggcggacggacctaggctacgacccgttcagaacgtcacgacccaaggcctcgaccccgtcg

SEQ ID NO: 303167 - DNA, 588 bp, Homo sapiens
  misc_feature: GZ8MTXP02IYDD3.9.71.G05.1.454.CMB.2.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatatggctattataaccttgtctcctggtatcaacaacgccagacaaacgcccccacactcttaactttatgaggtcactaacgccgccctcgtaggggtttctggtcgtctcctctgtccctaccaagtctgggcaaccaccggccctccctgaacatcctcgtggcctccagtctagacgcgaggctagattattactgcaagcctactatatcgtctaggtttcggtttaccttcttttacaaagttagttaacgtttcggggacgggtaacgggtaccgacggtcgtacggtcccgttacgtaacgtcgttaccgacgccccgaaacgggtccgtcccgtaccccccgg

SEQ ID NO: 303168 - DNA, 560 bp, Homo sapiens
  misc_feature: GZ8MTXP02GMIUD.9.71.G05.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctgtatcaacacgccagacaacgccccanactcttaattatgaggtcactaagccgccctcgtagggtttctggtcgtcttctctgcctcagtctggcacacggcctccngacatctcgtcggactccgagtctaggaccgacgaggtcctagtacttattacgtgacacgtctactatagtcgcttaggtttcgttcctntttacaagtattacggttcggacgggtacggaaccncggtccgtacggtacccgtcgtaacgtacgtcgacgaccccgaaggtccctaccgttcccccgg

SEQ ID NO: 303169 - DNA, 551 bp, Homo sapiens
  misc_feature: GZ8MTXP02GGANQ.9.71.G05.1.454.CMB.2.raw
  modified_base (291)..(291): a, c, t, g, unknown or other
  misc_feature (291)..(291): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaaagcccccanactcttaatttatgagtcactaagcggcctcgagggtttctggtcgcttctctgcctcaagtctggcaacacggcctcctgacatctctggctccagtctgacgacgagctgattattacgncanctatatatcgtactagtttcgttccttacgttacgaaagtagttacggtcgggacggtacggaccgtaggtccgtacggtacccgttacgtaaggtacgtaccgacgacccgtacggcccgtacccggtcccccg

SEQ ID NO: 303170 - DNA, 616 bp, Homo sapiens
  misc_feature: GZ8MTXP02FM2Y2.9.71.G05.1.454.CMB.2.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (397)..(397): a, c, t, g, unknown or other
  misc_feature (397)..(397): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattangaggtcactaagcgaccctnaggggtttctggtcgcttctctgcctcaagtctggcaacacgcctccctgacccaatctctcgggctccagtctgacgacgagctagactttatactgctagctcaattntcgtacgtagtttcgttaccttactttaacgaaagtagttacggttaccgggacgggtacgggaccgacggtacgtacggtacccgtcgtaggacgtacgaccgtacccggtaacggtcccgttacccgtcccccgttcggtaccctacccgttccgttaccccgttaacccccgtacccccgttccgtacgtaaccggtaccgttactaccgtaaccg

SEQ ID NO: 303171 - DNA, 584 bp, Homo sapiens
  misc_feature: GZ8MTXP02GGHO2.9.71.G05.1.454.CMB.2.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (368)..(368): a, c, t, g, unknown or other
  misc_feature (368)..(368): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactggacccaccactgatattgggctattataaccttgtctcctgtatcaacaacgccagacaaagccccanactctaattatgagtcactaagcgccctnacgggtttcnggtcgtcttcctctcgcctccaagtctgcaacacgcctcccngacaatctctggctcatctgacgcgagctagatattactgcagctcaatagtacgctagtttcggttccttactttacaaagtagttaacgttccggggacgggaacggggtaacccgaacgggtccgttaacgggtacccccgttacccgttaaggaaccggttaccgaaaccggtaccccgaaaacggggtcccgtcccggttaacccccccgg

SEQ ID NO: 303172 - DNA, 581 bp, Homo sapiens
  misc_feature: GZ8MTXP02IWIJM.9.71.G05.1.454.CMB.2.raw
  modified_base (235)..(235): a, c, t, g, unknown or other
  misc_feature (235)..(235): n is a, c, g, or t
  modified_base (328)..(328): a, c, t, g, unknown or other
  misc_feature (328)..(328): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctctggtatcaacacnccagacaaacgccccacactcttaattatgagtcactaagccgcctcgagggtttctggtcgtcttctctcgcctccaacgtctcggcaaccncgccctcctgaccatctctggctccgagtctgacgacggagtctagtaatttacttactgacagtctacattatgactagtttcggttccttctttacaagttatagttcgggacgggacgggtacccgaggtcgtcgacccgttcgtagacgtcgacgacccgaacggcctcccgacccccgttcggtccacctttccgtacccgttcccccgtacccccttcctcgtaaccgtaccttactaccgtaacgg

SEQ ID NO: 303173 - DNA, 541 bp, Homo sapiens
  misc_feature: GZ8MTXP02JFF19.9.71.G05.1.454.CMB.2.raw
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataccttgtctcctgtatcaacacgccagacaaacgccccanactctaatttatgagtcactaagcggcctcgtagggtttcnggtctctcctctcgcctcaagtctcggcacgacggtccctccctagactaactctcgtcggctccagtctgacgacgaggctagattatactgacagctcatatgcttagttcgttctctttacaagtatacgttacgggcggtaacggacctacgggtctcggtaacccgtccttaaggaccgtacgaccgaccgtacggtccgtcccgtccccgg

SEQ ID NO: 303174 - DNA, 624 bp, Homo sapiens
  misc_feature: GZ8MTXP02F40AT.9.71.G05.1.454.CMB.2.raw
  modified_base (313)..(313): a, c, t, g, unknown or other
  misc_feature (313)..(313): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatccaccatctcctgcactcggacccaccactgatagttgggactattactaaccttgtactccgtggtactcaacaacgcccagaccaacgcccccacactcttaattancgtagtcactaagccggcctcgtagggttctggtcgtcttccgtctcgccctacaacgtctcggccaaacaccgggtcctaccccgtgaacctaaacttcctcgtcggcctacccgaagtctcgacggacgaggctagtattactacgtgcacgtctacctatacgttcgaacgttacggtttcgttcccttacgtttaccgaaagttacttaacggtttccggacgggttacgggaccgtaacggtcgtaaccggtccgtaacccgtgacggtacaccgcccggaaacggtcctaccccggttcccccgg

SEQ ID NO: 303175 - DNA, 634 bp, Homo sapiens
  misc_feature: GZ8MTXP02JQ9RX.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatggctattataacttgtctctgtatcaacaacgccagaacaacgccccacactacttaattatgagtacactaacgccgcctcgtagggtttctgtcgtcttccctctcgtcctaccaagtctaggccaaccgtaccggccctacctcgaactaactctcgtcggccttccgagtctagacgacgacggtctagtattacttacgtcgactagtccttactattagtcgtacgttaggtttccggtttaccttcgtttaacgaaagttactttaacggttccgggggaaccgggaaccgggggtaaccgtacgggtaccgttaccggtacccggttaccgtaaggtaaccgtaccgaacccggacccgtaacgggtccccgtacccggttcccccccgg

SEQ ID NO: 303176 - DNA, 647 bp, Homo sapiens
  misc_feature: GZ8MTXP02F5I15.9.71.G05.1.454.CMB.2.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactcggacccacactgatagttgggctattataaccttgtctcctgtatcaacaacgcccaagaccaaacgcccccaacacttacttaactttatgaggtacactaaagccggccctcggtacggggtttctggtcgtcttcctctcgcctacagtctcggcaaccgaccggtcctaccctagactaactctcgtcggcctccgagtctagacgacggaggtctagtaacttattacgtcggactagtctacaattatccgtagttacggttttcggtttccctttatttaccgtaaagtactttaaacggtttccgggggacgggaaaccgggtacccgtaacgggtcccgttacggtaccccgttcgttaacggtaaacgttccgaacccggtacccgtaaccggtacccgtccccggtccccccgg

SEQ ID NO: 303177 - DNA, 638 bp, Homo sapiens
  misc_feature: GZ8MTXP02G1YLI.9.71.G05.1.454.CMB.2.raw
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctcgccctgactcagcctgcctcgtgtctgggtctccgtggacagtcgatcacctatcctcctcgcacgtacgacccacactgatagtggntattactactgtctctgtanacacaccgaccanaccaaccnccccatactattaattatagacgtacacgtacgccggtccgttcggtacgggttctcggtcgtcttcccgtctccgtcctacgtacgttcgcggcctaaccgccggtccctaccgtacgaactacgtcgtacgtccgtcctacgacgttcacggacgacgggagtccttagtactttacgtacgtcgacgcttactactaagtctcggttattacgggtttccttacttacgttaacgtaagtcggttacggtaccggggacgggtaccgtacggtacgttcggtaacgtaccgtttcggtaacgtacgtaccgtaccggaaccgtccgtacccggtccgtttcccccg

SEQ ID NO: 303178 - DNA, 555 bp, Homo sapiens
  misc_feature: GZ8MTXP02GNDKS.9.71.G05.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatagtggctattataaccttgtctcctgtatcaacacgccagacaacgccccanactcttaattangagtcactaagccggaccctcgtaggggtttctggtacgtcttcctctcgcctacagtctgcaacgacgcctccnacatctcgcggctcagtcngacgcgaggctagtatattactgactagtctacagtatcgactagtttcggttccttacgtttacaaagtattaacggttcgggacggtaacgggtaacgtcggttacgaacccgttctaggtaacgtcgaaccgaccgaaggtccctccggtccccgttccgg

SEQ ID NO: 303179 - DNA, 715 bp, Homo sapiens
  misc_feature: GZ8MTXP02F6OM3.9.71.G05.1.454.CMB.2.raw
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatcctcctgcactcggacccaccactgatagtggactattaactaccttgtctcgtgtactacaaccaaccgaccaacgaaccaaaccgaccccccaactaccttactttaaatttatagtacgtacaacgtaacgccggtcccgtcggtacgggtttcgtggtccgtcttccctctcgcctacgtacgtcgtcgccaaccgaccggtccctaccctacgaactaactccgttcggtacggtcctacccgtacgtccgtaacggaccggacggtacgtaccgttagttaaactttacgttaacctcggaccgtacggttcctaacgtaagttagtccgtacgtttacggttttccggtttaccctttacgtttaaccgtaaagttacgttaacgggttccgggggaacgggtaccgggaaccgtaacggtccgtaaccggtcccgtacgtaacggtaaccgaccgtacccggtaccggtacgtccccgtacccgttccccccgg

SEQ ID NO: 303180 - DNA, 533 bp, Homo sapiens
  misc_feature: GZ8MTXP02I3819.9.71.G05.1.454.CMB.2.raw
  modified_base (269)..(269): a, c, t, g, unknown or other
  misc_feature (269)..(269): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatgggcattataaccttgtctcctgtatcaacaacncccagacaaacgcccccacactcttaatttatgagtcactaagccgccctctaggggtttctggtcgtcttcctctgcctccaagtctggcaacacggcctccctgacaatctctggctcagtctgacgcgaggctgattattactgcagctcatatcgctagttcgttcctctttacaagtattacgttcgggacggtacggggaacccagggtctacgaccgttccgtgacggttcacgcccgaaggcctacggtccccccg

SEQ ID NO: 303181 - DNA, 651 bp, Homo sapiens
  misc_feature: GZ8MTXP02G0N4H.9.71.G05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcgacccacactgatattggactattactaaccttgtctctgtatcaacacgccaagacaacgccccanactacttaattangagtcaactaacgcccggtcctgtacgggtttctcggtcgtctttcctctcgtccctctaacgttccgtacggccgtaaaccgccggtacccttcccgtacgtaactaacttccgtacgtcgggtcctaccgtaacggtccgtaacggaccggaacggtacgggtaccttaggtaactttaacttaacgtggacctacgtccttataacgttgtacgtacttacgggtttcgttcctttaattaccgtaagtattacggttacgggacggtaacgggaccgttcggaccgttacggaccgttaccgtaaggtactacgacggaccgtacggtcccgttaccgtcccccgg

SEQ ID NO: 303182 - DNA, 757 bp, Homo sapiens
  misc_feature: GZ8MTXP02ICYF2.9.71.G05.1.454.CMB.2.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcgatcacctatcctcctgcactacggaccccaccactgtacttagttggactatttaacttaacccttgttcctccgttggttactacaaaccgaaccgaccccaagaaccaaaccgcccccccaactaaccttactttaaactttataggtacggtactaacgtaacggcccggcccgttcggtacggggtttcgtcggtcgtctttcctcctcgtccctacctaacgttccggtacgtccgaaacccgtacccggtccccttaccccgtacgtaaacctaacgttccgttaccgggttggggtccccctttaccgacggttacggttacccggggaaaccggtaccgggtacgggtacctttaggtaaacttttacgtaaacttcgggacctacgttctacctagttacgtgtaaccgttggtttcgtttacccttgtttaacaacgttaatttcgggtacggggtcgggaacgggtaaccgtacggtccgtaacgtccccgtgttaacggacgtacgaccggtacccgtacggtccctccccgttcccccgg

SEQ ID NO: 303183 - DNA, 529 bp, Homo sapiens
  misc_feature: GZ8MTXP02FIT46.9.71.G05.1.454.CMB.2.raw
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaaacgccccacactctaatttangaggtcactaagcgccctcgtaggggtttctggtcgtcttcctctgcctcaagtctggcacncgctccnacatctctggcctcagtcngtacgacgaggctgattattacgtgcagtctcatatcgtactagtttcggttctcttacaaagtattacgttcgggacgggacggacgaggcctacgcccgttcncggntaccgacgcccgaagccgtcctccccc

SEQ ID NO: 303184 - DNA, 561 bp, Homo sapiens
  misc_feature: GZ8MTXP02IICLB.9.71.G05.1.454.CMB.2.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcacccctcctcactcaggacacagggtcctgggccctgtctgccctgactcagcctgcctcgtgtctgggtcctcctggacagtcgatcaccatctcctgcactcggacccacactgatattggctattatactntctctgtatcaacacaccaagacaacgccccanactacttaattatgagtacaacgtacgccggtccctacgtagggtttctggtcgtctttcctctcgcctaccagtctggccaacgaccggccctcccgtagactaaatccgtcgtgggcctacgagtcgtacgacgacggagtactgtaattattacctcgctacgctacatagtgactagtttcgttccttagttacaagtacttacgtcggacggtacggaccgacggctacgtacctcgtaagcgtacacgacccgacgtccgtaccgtaccccg

SEQ ID NO: 303185 - DNA, 570 bp, Homo sapiens
  misc_feature: GZ8MTXP02I3F8O.9.71.G05.1.454.CMB.2.raw
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatagtgggactattataaccttgtctcctgtatacaacacgccagacaaccgccccanactcttaattngaggtcacgtaacgccgtaccctgtacgggtttctcggtcgtcttcctctcgcctcagtctgcaacaccggcctccngaacatctcgtggcctacgagtctagacgcgagctagtattactangacacgtctacatacgtgtcttacgtttcggttaccttagtttacgaaagtattacgggttcgggaccgggtaacgggaccaacgggtccttaccggaccgttcgaaggtctaccgacgtcccgaacgtccgtcccgtccccgg

SEQ ID NO: 303186 - DNA, 710 bp, Homo sapiens
  misc_feature: GZ8MTXP02GQVST.9.71.G05.1.454.CMB.2.raw
  modified_base (286)..(286): a, c, t, g, unknown or other
  misc_feature (286)..(286): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccacactgatattggctattataaccttgtctcctgtatcaacacgccagacaacgccccanactacttattatagtagtacactaagccgtccctcgtacggggtttctcggtcgtcttcccgtctccgtaccgtaccctaaggttcccgtggtacctaaaccgaccgggtccccttacccgtcggaacctaaacgttccgtaccgtgggtccctacgtacggtcgttacgaacggtaccggacggtcgtaggtaacttacttaactcgtaaccgtcgtactactaagtaacttcggtaaccgttacggttttccgggtttcctttacccttaagtaaacggttaccgtttaaaacggggtttccgggacggggaccggggttaaaacccgacggggtccgtaccggtaaacccggttccgtaacggtaccgttacggtaacccggaccccggtaaaacggtcccgttaacccggtcccccccgg

SEQ ID NO: 303187 - DNA, 617 bp, Homo sapiens
  misc_feature: GZ8MTXP02FXSQP.9.71.G05.1.454.CMB.2.raw
  modified_base (293)..(293): a, c, t, g, unknown or other
  misc_feature (293)..(293): n is a, c, g, or t
  modified_base (392)..(392): a, c, t, g, unknown or other
  misc_feature (392)..(392): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacaggtcctgggccctgtctgccctgactcagcctgcctccgtgtctgggtcctcctggacagtcgatcacctatcctcctgccactcggacccaccactgatattgggactattaactaaccttgtctctgtatacacaacgccagaacaaaccnccccactactacttaatttatagagtcaactaagcccgccctcggtagggtttctggtcgtctccctctcgcctcaagtctcgcaaccgccgcctcccngactaactctcgtcggcctacagtccgtagaccgacggaggtctagtattattacgtnacacgtctactagtactcgtcgttacggtttccgtttccttccgtttaactaagtaagttcggttaccggggtacgggacggtacccgtagggtaccgttacggtaacccgttcgtaagtccgtacgtacccgacccggtaacggtcccgtaccccggttccccccg

SEQ ID NO: 303188 - DNA, 650 bp, Homo sapiens
  misc_feature: GZ8MTXP02HLEVR.9.71.G05.1.454.CMB.2.raw
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
tcagtgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactcggacccaccactgatagttgggctattataaccttgtctctgtatcaacacgccagacaaacgccccacactcttaattatgagtacactaagcggccctgagggtttctggtcgtcttctctcgcctccaagtctcgcaacaccgcctcccgtagacccaatcctctacggctcatctagacgacgngctgaattactactgacagctacattancgtacgttacgttcgttaccttacgttactaaagtaacgttcggtttaccggggagggttaaccgggaaccgtacggtaccggttaccgtaacccggttccgttacggtaacgtaccgaacccggtacccgaaccggtttccgtaccccgtcccccgttccggtacccgttacccgtaccgtttacccccgtcccccgtaacccgttcccttaccggaaccggtttacctaccgtttaacccgtacggg

SEQ ID NO: 303189 - DNA, 701 bp, Homo sapiens
  misc_feature: GZ8MTXP02JJ8V9.9.71.G05.1.454.CMB.2.raw
  modified_base (230)..(230): a, c, t, g, unknown or other
  misc_feature (230)..(230): n is a, c, g, or t
  modified_base (464)..(464): a, c, t, g, unknown or other
  misc_feature (464)..(464): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtcgtgggtctccgtggacagtcgatcacctactctcctgcactcggacccacactgatagtggctattatacttntctctgtatacaacaccgaccacgacaaccgccccacacttacttaattagtagtacgtcaacgtaacgccggtccctgtacgggtttcgtggtctctctctgcctacgagtcgtacgacaaccgacccgtccctaccgtagtaactaacttccgtcgtcggggtccttaccggtacgttaccgtacgacggacggacgggtacctaggtaatttaaccgtacgtcgacgtacncttacgtattacgtgtacgtttacggttcggttttaccttaccgttagtaaacgttcgtacgggttaccgggacggggtacggggacgtacggtacgtcggtacccgtttcggacgggtacgtacccggacccggttaccggaaaccggttcccgtccccggtacccccggttcggtaacccctacccgttcccggtttaccccgtcccccgtcccgttacccgtaccgttaaccgg

SEQ ID NO: 303190 - DNA, 556 bp, Homo sapiens
  misc_feature: GZ8MTXP02F30QA.9.71.G05.1.454.CMB.2.raw
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgatattgggcattataaccttgtctcctggtatcaacaacgcccagacaaacgccccanactctaattatgagtcactaagcgccctgagggtttctggtcgcttctctgcctcaagtcnggcaacgaccgcctccagacaatctcgtgggctccagtctgacgacgagctgattatactgcagctacatatcgctagttcggtccttctttacaagtatagttcggacgggacggacgaggctcgtaaccgtcctaggacgtcaacggacccgtaaacggcccgttaccgccccccgttacggtccgtaaccttccgtaccgttcccccgtcccttcccgtacgtaaaccg

SEQ ID NO: 303191 - DNA, 624 bp, Homo sapiens
  misc_feature: GZ8MTXP02GS6HT.9.71.G05.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatattgggctattataacttgtctctgtatcaacacgccagacaacgccccanactcttaatttangagtcactaagcgtcctgtagggtttctggtcgtcttccctcgtcgcctacctaagttccgtggccaaaccgtaccggtcccctacccgttgacctaaacgttccgtacgtcgggcctaccgacgttcctaggaaccgacggaggtcctgtaagtttattaacgtgactagtctacaattntacggnttacggtttgttccttcgtttanaagttattacggttcggggacgggtaacgggtaccctaggtaccgtaccggtaccgtttcgaacgtaaccggttacgacggtaccccgaaaacggtccccgtaccgttacccccgg

SEQ ID NO: 303192 - DNA, 536 bp, Homo sapiens
  misc_feature: GZ8MTXP02FI8P1.9.71.G05.1.454.CMB.2.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttcctctgcctcaagtctggcaacacggcctccctgacatctctggctccagtctgacgacgaggctgattattactgcagctcatatgctagtttggttccctacttttgaaaagtattaacgttcggggacggtacggggacccagggcttacgaccgttcctgacgtcacgcccgaacggctaccgcccccg

SEQ ID NO: 303193 - DNA, 583 bp, Homo sapiens
  misc_feature: GZ8MTXP02H751Z.9.71.G05.1.454.CMB.2.raw
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgattagtggactattataaccttgtctctgtactacaacacgaccagacaaacgcccccanactacttaattangtagtcactaacgcgcctgaggttctggtcgtnttccccctntcgtcctactaagtcgtacgccaaccgacgccctcctagactaatctacgtcggctcagttcagacgacgagtctgtattagtactgcagtctgatagtcgaacttcggtttcgttacctactagttaccaaaggtacttaaggtttccgggacggtaaccgggaccgtaacggtccgtaccggtacccgtccgttacgacgtacgaccgaccccgtaaacgtccgtacccccgg

SEQ ID NO: 303194 - DNA, 600 bp, Homo sapiens
  misc_feature: GZ8MTXP02IU16W.9.71.G05.1.454.CMB.2.raw
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctcgccctgactcagcctgcctccgtgtctggtctccgtgacagtcatcacatctctgcactcgacccacactgatagtggactattactaaccttgtctctgtatcaacacgccagacaacgccccacactacttaattatagtacgtacacgtaacgccgtccctacgtacgggtttctcgtcgtcttcctctcgtcctactaagtcgtgcaacgaccgtcccgtacctacgactaattcctacgtcggtcctccgagtcgtagacgacgagtctagtattacttactagcagtactctatactgtctagtttcgttacttcttaacgtaagtagttacggttcgggacggtaacggtaccgtacggtaccgtaccggtaacccgttacgtcggtaccgtacgaacccggtacccgtaacggtccccgttacccgttccccccgg

SEQ ID NO: 303195 - DNA, 649 bp, Homo sapiens
  misc_feature: GZ8MTXP02JQ7DA.9.71.G05.1.454.CMB.2.raw
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcacgtcggacccaccactgattattggctattataaccttgtctcctgtatcaacaccgccagacaacgcccccacactcttaatttagtgtaggtcacgtaacggccggtccctacgtacgggtttctggtaccgtcttactccgtcgtcctaccaagtcctggccaacacggccctccctagaccactctacgnggcctcagtcngtacgacgaggctagtattagttacngcagcgtcagttatgtaccgtacggtttcggttaccttacctttaagaacgtagtttaccggttacggggacggggtaaccgggtaccccgtagggtcccgtttaaccgggacccgttaccggttaagggtaaccggttccggaaaaccccgggtcccgtttaaacggggcccgttaccccccggtttaccccccggggg

SEQ ID NO: 303196 - DNA, 681 bp, Homo sapiens
  misc_feature: GZ8MTXP02G7GH5.9.71.G05.1.454.CMB.2.raw
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (434)..(434): a, c, t, g, unknown or other
  misc_feature (434)..(434): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctggtctccgtggacagtcgatcacatctcctgcactcgacccacactgatgtggatattatacttgtctctgtatacaacacgaccagaacaaccnccccactacttactttaatttanagtacgtcaacgtacgcccgtcccgtggttacgggttcgtcggtcgtcttcctcgtctcctactagtccgtgaccgtaaccgaccggtccctaccgtacgaactactccgtcgtcggtaccctccgagttacncggtaacgacgaggtccttagtactttaacgttcacgtacgtacttctactattagtcgttacgttacggttttaccgttcctttacgttaaccgtaagttaacgttaccgggttaccggggacggggtaaccgggtaaccgtacggtaccgttacccgggttaaccccgtcggttaacgggtaaccgttaccgtaaccccggaaccggtaaccccggttccccgtaacccccggtttacccccggg

SEQ ID NO: 303197 - DNA, 792 bp, Homo sapiens
  misc_feature: GZ8MTXP02I238D.9.71.G05.1.454.CMB.2.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctcgccctgactcagcctgcctcgtgtctcggtctccgtggacagtcgatcacctatctcctgccactcgacccacactgatgtggactattatacttntctctgtatcaacacnccagacaaccgacccccatacctattaactttagtagtacgtacaacgtaacggcccggtcccgttacggtacggggttttccgtcgggttccgttcttaccccgttccttccgtacccgttaccctaaggttcccgtacggtacctaacccgtaccgggtacccccttaccccgttagaacccgtaaaccttccgttacggtccggggttacccttaacccggtgttaaccggttccgaaacgggaaccccgggtaggtaacccgtttagttaaaaccgtttactttaaacccggcgtaaaccggtaccgttaacttacccgtaagtttaacgttcccgtaaacgggtttcgttttacgggttttacccctttaacgtttaaccgaaaagtaacgtttaacgggggttacggtaaccggggaaccggggttaccgaacgggtccggttacccgtacccgtaccggtaagtaccggtaaccgtacggaaccccgtaacggtcccgtccccgttacccccgg

SEQ ID NO: 303198 - DNA, 728 bp, Homo sapiens
  misc_feature: GZ8MTXP02I5KFQ.9.71.G05.1.454.CMB.2.raw
  modified_base (307)..(307): a, c, t, g, unknown or other
  misc_feature (307)..(307): n is a, c, g, or t
  modified_base (488)..(488): a, c, t, g, unknown or other
  misc_feature (488)..(488): n is a, c, g, or t
  modified_base (534)..(534): a, c, t, g, unknown or other
  misc_feature (534)..(534): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctcgccctgactcagcctgcctccgtgtctgggtctcgtggacagtcgatcaccatcctcctgcacgtcgaccccacactgatagtggctattaataccttgtctcgtgtactcaacaccgccaagacaaccgccccatactctttaattnagtacgtccaacgtacggcccgtacctcggttacggggtttctcggtcctacttcccgtcctcgtaccctactaacggtccgacgtaccaaaccgtcccggtccctacccgtataacctacgtccgttaaccggtcgggtacccttaccgaaggttcccgtaacgggtaccggtaacccgngggttaccttacggtactttaacgttccgtcggaactacccggttntacgtagttacctcggtacgtttacggtttcgttaccttacgtttaacgacgttaacggttaccgggtaccggggtaacgggtaccgggtaaccgtacgggttcccgttaaccggggtacccgttacggtaacgggtaccgttaacccggaccggttacccggtaccggttaccccgttccccgggttaccccg

SEQ ID NO: 303199 - DNA, 568 bp, Homo sapiens
  misc_feature: GZ8MTXP02GTRN8.9.71.G05.1.454.CMB.2.raw
  modified_base (292)..(292): a, c, t, g, unknown or other
  misc_feature (292)..(292): n is a, c, g, or t
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggctattataaccttgtctcctgtatacaacaacgccaagacaaacgcccccanactcttaattatgagtcactaagccggcctacgtaggggtttctggtcgtcttcctctcgcctaccaagtctggctaacacggcctcctgacaatccncgtggcctcagtctagacgacgagtctagtattacttacngtcacgtctatatacgtcgtacgttaggtttcgtttaccttacgttacgtaagttagttacggtcgggacggacggtaccgtacggtcgtacgtccgtacgtgacgtacgacgaccgtacggtcccgtaccgtccccg

SEQ ID NO: 303200 - DNA, 655 bp, Homo sapiens
  misc_feature: GZ8MTXP02HTMGT.9.71.G05.1.454.CMB.2.raw
  modified_base (246)..(246): a, c, t, g, unknown or other
  misc_feature (246)..(246): n is a, c, g, or t
tcagtgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattggacattactaacttgtctctgtatacaacacnccagaacaacgccccacactcttaattatgacgtcactaacgccgcctcgtagggtttctggtccgtctctctcgcctctaagtctacgacaccacccgtcctcctgaactaactccgtcgtcggggtcctccgtagtccgtagaccggacgtacggtctagttaactttaattacgtgtacctacgtctactactagttacgacgttaggtttccgtttacctttcttttaacgaacgttaggttaccggttacggggaccgggtaaccgggtaccgacgggtaccttacgggtacccgttccgtacggacgtacggaccgtaccccggtaacgtcccgtccccgtcccccgtcggtaaccctaccgttcccgttcccgtacccctacccctcccgttacgtaacccg

SEQ ID NO: 303201 - DNA, 593 bp, Homo sapiens
  misc_feature: GZ8MTXP02G3ZOV.9.71.G05.1.454.CMB.2.raw
  modified_base (463)..(463): a, c, t, g, unknown or other
  misc_feature (463)..(463): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataaccttgtctcctggtatcaacaacgccagacaaacgcccccacactcttaaatttatgaggtacactaagcgccctcgagggtttctggtcgcttcctcgtcgcctcaagtctggcaacacggcctcctgacaatctcgtggctccagtctgacgacgaggctgaattacttaactcgactacgctacaatatggtcctaaggtttggttaccccttnttttaccgaaaacgtattaaacgtttccgggacgggtacggggaaaccctgggggtacctcggaaccccgttacgtcgtaacgggttaccaaccggtacccgaaaacggtcccctacggttcccccccgg

SEQ ID NO: 303202 - DNA, 783 bp, Homo sapiens
  misc_feature: GZ8MTXP02HJYED.9.71.G05.1.454.CMB.2.raw
  modified_base (275)..(275): a, c, t, g, unknown or other
  misc_feature (275)..(275): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactgacccacactgattagtggactattactaaccttgtctcgtgtatacaacaaccnccaagaaccaaacgtacccccaactacttactttaaatttagtgaacggtactaacgtaacggcccggtacccgtcggttaacggggtttctcggtcgtccttcccgtcctacggtcccttaccgtaacgtcgttacggacctaaccgtacccggtccccttacccgtacgtaaaccctaaagttcccgtccgttacggggtcccttacccgtacgggtaccttacggggaaccggtaacgggacgttaccgttaaggttaaacgtttaactttacccgaggtacctaccggttactaccctaagttaacgtcggtaaccgtttaacgggtttccggtttaccttaaccgtttaagaaaacggttacgtttttacgggacccggggttaacgggggaaccggtaaccgtaacgggttccgtaccggggtaccctttacccgaaggtaaccggtaaccgaaccggtaaccccggtaaccggtacccccgttacccccgggtttcccccg

SEQ ID NO: 303203 - DNA, 564 bp, Homo sapiens
  misc_feature: GZ8MTXP02H5HTN.9.71.G05.1.454.CMB.2.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccacactgatattggctattataacttgtctcctgtatcacaacnccanacaacgcccccanactnttaattntgagtcactaacgccgcctcgtagggtttctgtcgcttcctctncctcagtcngcaacncggcctccngacatcctcgtggcctcgagtctagacgacgagctagattagtactgnagtctactatattagcgttaggtttcgtttacctcgttttacgaaacgttcttacgtacggggtaccgggtacggaccgaacgtcggttaccgacccgttcgtaacgtacggtaccgacggaccccgtaaggtccccgtaccgtccccccgg

SEQ ID NO: 303204 - DNA, 595 bp, Homo sapiens
  misc_feature: GZ8MTXP02HWPMT.9.71.G05.1.454.CMB.2.raw
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcatcaccatctcctgcactcggacccaccactgatattggctattataaccttgtctcctggtatacaacacgccacgaaccaacgccccanacttacttaattagngagtcacgtaagcgcctgtagggttctggtctcttcctctcgcctactagtctgccaacgacgtcctcccgtagactactcctcgtcggctccagtctcgacgacgnggtctagtattatacncgcagtctacntagtcgtcgttagtttcggtccttacttacgtaaagctttaggtaccggggtaccgggaaacggttaccgaacgggtcccttacggtacccccgtcgtaacgggtaaaccgtccgacccgccccggtaacggccccgttcccggtccccccgg

SEQ ID NO: 303205 - DNA, 569 bp, Homo sapiens
  misc_feature: GZ8MTXP02ICBRJ.9.71.G05.1.454.CMB.2.raw
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (332)..(332): a, c, t, g, unknown or other
  misc_feature (332)..(332): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcatcacatctcctgcactcggaccacactgatagtggctattatacttgtctctgatcaacacnccagaacaacnccccanactnttaaatntagagtcaactaagcgcctgacgggtttctggtcgctttcncctacgtcctactagtctggcctaacacggtccctcccagactatctcgtggctcgatcgtgacgtacgaggtctagtactttaagtacttagacacgtcttacaaatcgttnacgttagtttcggtttaccttcgttacaaagtagtttaacgttcggggacggtaacgggaccgtacggtcgtaccgaccgttcgtaagtacgtacgacgacccgtaacggtctcccgtaccccg

SEQ ID NO: 303206 - DNA, 589 bp, Homo sapiens
  misc_feature: GZ8MTXP02H1XTZ.9.71.G05.1.454.CMB.2.raw
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtcctctggaccagtcatcacctatcctctgcacgtcggaccccacactgattagttggactatttactaacttgtctctgtatcaacacgccagacaaacgccccanactactttaagttanagtagtcaactaacgccggccttcgtacggggtttctgggtctccttcctactcgtccctaccaagtctcggcaaccgcggtcccctcctagacaacttcncgtcggccttcacgttcacgacgccgaggtctagtattatcctgcctagtntacgatntgtctgttcgttcttacttacctacgtagttacgttacggttcgggtacggtacgtaacggcgtaccgtaaccgtccgttaacgtacgtacgaccgaaccgaccggccgtcccgttcccccgg

SEQ ID NO: 303207 - DNA, 550 bp, Homo sapiens
  misc_feature: GZ8MTXP02GAS2Z.9.71.G05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactggacccacactgatattgggctattactaaccttgtctcctgtatcaacaacgccaagacaaacgccccanactcttaatttangagtcactaagccgcctcgtagggttcnggtcgcttcccnctgcctcaagtctggcaacncggcctcctgacatctcgnggtcctcagtactgacgcgagctagattactacngacgtacgcttcagtatcgctagtttcgttacctntttacgaagtgttacgttcgggacggtacggtacacgggtctaacggtccgtccgtaagcgttaccgacggacccgtaacggtccgaccgttcccccgg

SEQ ID NO: 303208 - DNA, 569 bp, Homo sapiens
  misc_feature: GZ8MTXP02ITKL9.9.71.G05.1.454.CMB.2.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggctattataaccttgtctcctgtatcaacacgccagaccaacgccccanactcttaattangtagtcactaagcgccctgagggtttctggtcgtcttcctctcgcctcaatcgngcacacgcctcctgacatcncgtggctccgatcgtgacgacgagtctagtattactactcgacagtctactattagtcgcgttaacgtttcggttccttaccttttagaaaactactttaacggttccgggacgggtaacgggaaacctcgggtccgttacggtaacccgttcctaaggactaccgacaccccgacggtccaccccggttcccccg

SEQ ID NO: 303209 - DNA, 507 bp, Homo sapiens
  misc_feature: GZ8MTXP01EHISC.10.87.H10.1.454.CMB.2.raw
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctgtagagacagagtcaccatcacttgtcggcagtcagcctatagcagctggttagcctggtatcagcagaagccgagggggacncccctaagctcctgatctatgctgcatccagtttgcagagtcggggtacccgtnaaggttcaggcggcagtgggatcgtgggacaggatttcgctctcaccatacaacaacctgcagcctggtaggtattttgactaacttactactcgtacaacgaggctagctacgttcccacttcgacgtttccggcccgggttacaaaggtggagtcaaacgacttgtcgcgtaacg

SEQ ID NO: 303210 - DNA, 562 bp, Homo sapiens
  misc_feature: GZ8MTXP01BTZVK.10.87.H10.1.454.CMB.2.raw
  modified_base (280)..(280): a, c, t, g, unknown or other
  misc_feature (280)..(280): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccgagggggacncccctaagctcctgatctatgcttgcatccagtttgcgagtaggtcggggtaccccgtcgaagggttcaggtcgggcaggtggatcgtgggacagtattcgctctcacatcaaacacctgacagccgtgtacggtattttcgactaacttactactacgtactaacgaggtcctaggcctacgtttccccacttcccgtaccgtttcccgggaccccgggttaaccaaacgggtcgggaacgggttaaccaaaaccggaacgttcggtcgggttaactccgg

SEQ ID NO: 303211 - DNA, 559 bp, Homo sapiens
  misc_feature: GZ8MTXP01AXE3X.10.87.H10.1.454.CMB.2.raw
  modified_base (285)..(285): a, c, t, g, unknown or other
  misc_feature (285)..(285): n is a, c, g, or t
  modified_base (551)..(551): a, c, t, g, unknown or other
  misc_feature (551)..(551): n is a, c, g, or t
tcagcatagtagtgcacgaccggtgctcgatttagcagtactgcgttgggtttgggggcaggagtcagacccagtcaggacacagcatggacatgagggtccccgctcagctcctggggcctcctgctgctctggcctcccaggttccagatgcgacatccagatgacccagtcctccatcttccgtgtctgcatctggtaggagacagagtccaccatcacgttggcgggcagtcagcctattagcagctggttagcctggtatcagcagagccgagggggacnccctaagctctgatctatgctgcatcctagtttcgcgaggtacggtcgggggtaccccgtagaacgggttcaacgggtccgggacgtagggtgggacttccggtggggacctaggtactttcggctctaccactataccaaacacctgacacgccgtagaggttatttacgacttaacttactacttagtacaacgaggtctagctacgttcccacttccgtaacgtttccggaccccggacaggtcggagtaacaacgagttcgngcgtaacg

SEQ ID NO: 303212 - DNA, 548 bp, Homo sapiens
  misc_feature: GZ8MTXP01B3DYT.10.87.H10.1.454.CMB.2.raw
  modified_base (279)..(279): a, c, t, g, unknown or other
  misc_feature (279)..(279): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggtagcctggtatcagcagaagccgagggggacncccctaagctcctgatctatgctgcatcctagtttgcaggaggtcggggtaccccgtgaagggttcaggtcgggcaggtgggatcgtggggacagtatttcgctctacaccataccaacaacctgcacgccgtgaggtatttgactaacttactactgtacaaacgtaggtctagcctacgtttcccacttccgtaaccgtttccgggacccccgggttacttaaacgggttggaacggtaactaaaacggacgttggtcggcgtaacg

SEQ ID NO: 303213 - DNA, 568 bp, Homo sapiens
  misc_feature: GZ8MTXP01BMVVM.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccagccgtgggggtccctgagactctcctgtgcagcctctggattcgacttcgaaatgtctggcatgcactgggtcccgccaggctccaacgaagggggctgggagtgggtggctagttctttcatttgatagaaaaagggatattatgcgctcgtgaagggccgattcagcatctccagagacatttaccgaaggccacggtgtaactctagaccaaagtcgaaccagccctaggagaagtgaaggacacggctagtgtaactagttggtcgacgaaaggtcccttccaccgttagaaacctaataaggtcgggggtactttaggaaccgttaaggtaaccggggg

SEQ ID NO: 303214 - DNA, 478 bp, Homo sapiens
  misc_feature: GZ8MTXP01CDHSM.10.87.H10.1.454.CMB.2.raw
  modified_base (277)..(277): a, c, t, g, unknown or other
  misc_feature (277)..(277): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccagggggancccctaagctcctgatctatgctgcatccagtttgcagagtggggtacccgtcaaggttcagcggcagtggatctgggacagattcgctctcaccatcaacaacctgcagcctgaggtatttgactaacttactactgtcaacaggctagctagttccacttcgacgttcggcccggcaagtgagtcaagacttgtgctcg

SEQ ID NO: 303215 - DNA, 589 bp, Homo sapiens
  misc_feature: GZ8MTXP01D6Z6X.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtgggggtccctgagactctcctgtgcagcctctggattcgacttcgaaatgtctggcatgcacgtgggtcccgccaggctccgaacggaagggggctgggaggtgggtggctaggtttctttcatttgaataggaaaaaaggatattatcgcgaaccgtccgtgaaacgggccgaattcagcatctccagagactatttaccgaaggccacggtagtatctagacaaagtcgaaccagcctagagaagtgaaggacacggctatgtaactagttgtgacgaacggtacccttccgacccgttagaaaacttaagtaaggttacggggggtctttacggaacgttaacggtaaccggggg

SEQ ID NO: 303216 - DNA, 544 bp, Homo sapiens
  misc_feature: GZ8MTXP01CTQBR.10.87.H10.1.454.CMB.2.raw
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttggtcgggcagtcagcctattagcagctggttagcctggtatcagcagaagccgagggggacncccctaagctcctgatctatgctgcatcctagtttgacgaggtacggtcggggtacccgtagaaggttcaggcggcaggtggatcgtgggacagtattcgctctacaccataccaacacctgacacgtcgtagtaggttatttcgacctaacttactactagtacaaacgtaggctacgtctacgtttcccacgttccgtaaccgtttccgggaccccggacaaacggtcggaacgtaacaaacggacttcggtcggctaacg

SEQ ID NO: 303217 - DNA, 566 bp, Homo sapiens
  misc_feature: GZ8MTXP01B3NUD.10.87.H10.1.454.CMB.2.raw
  modified_base (279)..(279): a, c, t, g, unknown or other
  misc_feature (279)..(279): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccgagggggacnccccgtaagctcctgatctatgctgcatccagtttgcaggaggtggggtccctgaaggttcaggtcggcagtggatcgtgggacagtattcgctctacacatacaacacctgcacgccgtagaggtatttcgactaaacttctactgtacaacgtaggtctaaggtcctaacgttttccccaacttccgtaacccggttttacccgggacccccggggttaaccttaaaacgggttcgggaaacggggttaaccaaaacccggacgttaggtcggggaaccttccgg

SEQ ID NO: 303218 - DNA, 557 bp, Homo sapiens
  misc_feature: GZ8MTXP01B5CN8.10.87.H10.1.454.CMB.2.raw
  modified_base (282)..(282): a, c, t, g, unknown or other
  misc_feature (282)..(282): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacgttggtcgggcgagtcagcctattagcagctggttagcctggtatcagcagagccgagggggacnccccgtaagctctgatctatgctgcatcgacgtttgcaggaggtcggggtacccgtcgaagggttcaggcggcgaggtggatcgtagggacagtattcgctctacgaccatcaaacacctgacacgcgtgtaggtatttcgacttaacgttactacgtgtactaagtacggtctaaggcctacgtttcccacttcgtacccgtttccgggaccccgggttaacttaaacggggtggtaacggtaaccgaaacggtacgttgggtcgttaacgtcg

SEQ ID NO: 303219 - DNA, 557 bp, Homo sapiens
  misc_feature: GZ8MTXP01EGK5U.10.87.H10.1.454.CMB.2.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccattcttccgtgtctgcatctggtagganacagagtcaccatcacgttggtcgggcagtcagcctatagcagctggtancctggtatcagcagaagccgagggggacacccctaagcctcctgatctatgctgactatccgtagttcgacgtaggacggtcggggtaacccgtagtaagggttcagggcgtacagggtcggatcgtgggactaggtactttcgcttctaccactacacaacaacctggacacgtccgtaggtacggttatttcgaactaacttactatacgtacaaacgcgtactagcctaacgttcccaacttcgtacccggttcgaccccggacaaaggtcggacgtaaccgaaagtcttggtcgctaacg

SEQ ID NO: 303220 - DNA, 537 bp, Homo sapiens
  misc_feature: GZ8MTXP01AXPBD.10.87.H10.1.454.CMB.2.raw
  modified_base (279)..(279): a, c, t, g, unknown or other
  misc_feature (279)..(279): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccgagggggacncccctaagctcctgatctatgctgcatccagtttgcagacggtcgggggtaccccgtgaacggttcgaaggcgggcgtaggtgggatcgtggggacagtatttcgctctacacataccaaacaacctgacagccgtagacggtatttcgactaacttactactgtacaacaggctagctacgttcccacttcctaccgtttccgggaccccgggacttaaacggtggaggtaacaaacgtacgttgtaacggctaacg

SEQ ID NO: 303221 - DNA, 551 bp, Homo sapiens
  misc_feature: GZ8MTXP01AFRYQ.10.87.H10.1.454.CMB.2.raw
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgagactctcctgtgcagcctctggattcgacttcgaaatgtctggcatgcactgggtccgccaggctccaacgagggggctgggagtgggtggcagttcttcatttgataggaaaaaggatatatgcgctccgtagaagggcattcagcatctccagagacatttaccaaggccacggtntactctgacaaagtcgaaccagccgtagagaagtgaggacacggctangtaactnttgtgcgaacggtccttaccgaccttacgaaactaagtaaggtggggggtactttggaacgttcggtccggggg

SEQ ID NO: 303222 - DNA, 574 bp, Homo sapiens
  misc_feature: GZ8MTXP01DHMRA.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccagccgtgggggtccctgagactctcctgtgcagcctctggattcgacttcgaaatgtctggcatgcacgtgggtccgccaggctccgaacgaaggggctgggagtgggtgctagttctttcatttgatagaaaaaagggatatatagcgccgtcgtagaacgggccgattcagcatctaccagagactactttaccgaacggtccacggtgtactctagacaaagtcgaaccagcctagagaagtgaggactaggctagtgtaactagttgtcgacgtaacggtaccttaccgacgttagtaaacctaagtaaggtacgggggtactttaggaacgttcggtaacggggg

SEQ ID NO: 303223 - DNA, 549 bp, Homo sapiens
  misc_feature: GZ8MTXP01CY1Q6.10.87.H10.1.454.CMB.2.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctcatcttccgtgtctgcatctgtagganacagagtcaccatcattgcggcagtcagctatagcagcnggtagcctggtatcagcagaagccgagggggacncccctaagctcctgatctangctgcatccagtttgcaggtagtcggggtacccgtacgaaggttccaagcgggtacgaggtcggatcgtagggactaggtatttcgactctacaccatacaacaactgacagccgtaggagttatttcgacctaacttactactagtacaaacgtaggtactaggctacttccctacttaccgtaccgtttccgggaccccggttacaaacggttcgggaacgttaaccaaaacgtaccgttagtcggcgtaaccg

SEQ ID NO: 303224 - DNA, 529 bp, Homo sapiens
  misc_feature: GZ8MTXP01B88M4.10.87.H10.1.454.CMB.2.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (342)..(342): a, c, t, g, unknown or other
  misc_feature (342)..(342): n is a, c, g, or t
  modified_base (390)..(390): a, c, t, g, unknown or other
  misc_feature (390)..(390): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcaagcctatagcagcnggtagctggtatcagcagaagccagggggancccctaagctcctgatctatgctgcatccagtttgcagagtggggtaccctcaagggttcagcggnagtggatctgggacaggattcgcttcacaccatcaaacaacctgcacncgtagtagtattacgtactaacttaactactactactaacgagactagtaactacgttacctacttaccgtaccgttaccggttacccggaaccgaaacggtaaggtaacggtaacgaaacgtaacgttacgtcgcgtg

SEQ ID NO: 303225 - DNA, 702 bp, Homo sapiens
  misc_feature: GZ8MTXP01CVANN.10.87.H10.1.454.CMB.2.raw
tcagcatagtagtgcacgaccggtgctcgatttagcagtactgcgttggggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgacgactctcctgtgcagcctctggattcgacttcgaaatgtctggcatgcacgtgggtccgccaggcctccgaaacggagggggctgggaggtgggtggctagttctttcatttgaataaggaaaaaaagggtataattatacgacgtaaccgtccggtaggaaacgggcctaagttcagcatcctaccaagacgaacctaacgtttaccgaaacgggtcctaacggtcgtaactcgtacgaactaaaggttcgaaccgacgacccgtaggaagtaaaggtaggaaacgggacgtaacgggtacttaacgttgggttaaccttaaggttggtacggttaccggtaaaacgggtaaccccgtttaacccgaaccgttaacggtaaaaccgttaaacggttaacgggtttacggggggtacgtttaacgggtaaccggttaaccgggttaacccgggggg

SEQ ID NO: 303226 - DNA, 592 bp, Homo sapiens
  misc_feature: GZ8MTXP01D6ZIL.10.87.H10.1.454.CMB.2.raw
  modified_base (276)..(276): a, c, t, g, unknown or other
  misc_feature (276)..(276): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagcctatagcagctggtagctggtatcagcagagccgaggggacncccctaagctctgatctatgctgctatccgtagtttggacgtaggtacggttccgggggtaccccgtacgtaacggggttcacgggccgggacgtagggtgggagtccgtagggactaggtacttcgctctacacctatacaacacctgacacgtcgtagtaggtatttcgactaaacttactactagtaccaaacgtcggtactacgaaccttacgttccccaacgttcccgtaaccgtttcccggggaccccgggttaacgttaaacgggtcgggtaaacggtaacctaaaacggacgttaggtcggctaaccg

SEQ ID NO: 303227 - DNA, 581 bp, Homo sapiens
  misc_feature: GZ8MTXP01DAYT2.10.87.H10.1.454.CMB.2.raw
  modified_base (306)..(306): a, c, t, g, unknown or other
  misc_feature (306)..(306): n is a, c, g, or t
  modified_base (448)..(448): a, c, t, g, unknown or other
  misc_feature (448)..(448): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagctctcctgtgcagcctctggatcgacttcgaaatgtctggcatgcacgtgggtccnccaggctccgaacggaaggggctgggagtgggtgcagtttccttcatttgatagaaaaaaaagggataatatgcgtacctccgtggaagggcctattcagacgatcaccaagacgtactacttccgaaggcccgtaacggtnttacgtcttaggacaagtcgaccagccgtagaaggtaagtggacggacaacggtcttaagtgttacgtagttggttcgcgaaacggtcccttaccgaaccttagaaacttagttaacggttggggggtttaac

SEQ ID NO: 303228 - DNA, 550 bp, Homo sapiens
  misc_feature: GZ8MTXP01DKBCZ.10.87.H10.1.454.CMB.2.raw
  modified_base (442)..(442): a, c, t, g, unknown or other
  misc_feature (442)..(442): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgagactctcctgtgcagcctctggatcgacttcgaaatgtctggcatgcacgtgggtccgccaggcctccaacggaagggggctgggagtgggtggcagtttccttcatttgatagaaaaaaaaagggtataattatgacgtacctccgtgaacgggccattcagcatctccagagacattccaagcctacgtntagtctagacaaatgaccagcctagagtaagtgaggacaacggcttagtgttacttatgttgcgaacggtaaccttccaactagaaacttagtaagttgggggttaac

SEQ ID NO: 303229 - DNA, 633 bp, Homo sapiens
  misc_feature: GZ8MTXP01ELYVY.10.87.H10.1.454.CMB.2.raw
  modified_base (298)..(298): a, c, t, g, unknown or other
  misc_feature (298)..(298): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatccttccgtgtctgcatctgtaggagacagagtcaccatcacgttggtcgggcgagtcagtcctattagcagtcgtggtacgccgttggtatcgagcgaaggaacggccggaagggggaccncccctaagctcctgactctatgctgcactccgtagtttcgacgtaggtacggtcggggtaccctagtaacggtcaagggccggtacagggtggacgttcggtagggtactaggttactttccgccttactaccaacctaactaccaaacaccgtgacgtacgtccgttaggtaacggtttactttacgaccttaacgttactacgtacgtacaacgtcggtacctacggtaaccttccgtttacccacgttacccgtacccggtttacccgggaccccgggttaaacaagggttcgggaaacgtaaccaaaacggtcgacgttcggaactaaccg

SEQ ID NO: 303230 - DNA, 847 bp, Homo sapiens
  misc_feature: GZ8MTXP01CSWM6.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctgggtggagtcgtgggggaggcgtggtccagccgtgggggtccctgagactctcctgtgcagcctctggattcgacttcgaaatgtctggcatgcacgtgggtcccgccaggcctaccgaacggaagggggctgggaggtggggtggctagtttctttactagtttagaagtaaggaaaaaaagggtattaagttaagtcggacccgtaacccgttacccggtagggaaaacggggtccccgtaagtttaccgaaggtaccctaacttacccgtacccgaacggtaacggtaacccttaaacgttttacccgaaacggggtaccccgttaaaccggggttaggttaacttaccggttaacgaacgtaaaaacgggttaccggtaaaccccgtaacgggaccccgtttaaacggggaaacggtaaaggggttacggaaaccgggggtaaaccgtaaacccgggggtacccttaaaggtttaacgttaaccgttttaaagtttacggggtacgttaaccgggtaaaaccgggttacccctttaaccccggttaaacccgttaacggtaaaaacccgttaaaggttaacgggtttacgggggggggttacctttttaacggggaaacccggttaaccggggtaacccgggggg

SEQ ID NO: 303231 - DNA, 695 bp, Homo sapiens
  misc_feature: GZ8MTXP01A0BH6.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggcttcttttaggaggtgcccagtgtcaagtgcagcgtggtggagtcgtgggggaggcgtggtccagccgtgggggtccctgagactctcctgtgcagcctcgtggtattcgacttacgaaatgtctggcagtgcacgtcgggtcccgccgaggcctaccgaaacgggaacggggcgtgggaggtgggtggctagtttctttacgtagtttagaagtaaaggtaaaaaagggtattaattagtacggaccgtaaccgtcgggtaggaacgggtccgtattacgacgtcactctacgagacgtactacgtttaccgaacggtaccgtacggtacgtactacgtagacaaacgtacgaaccgtacgtaccgtaggaacggtaaggtacggaacggacgtacggtacttagtacgttaacttagttacggtcgttaaccggtaaccggtacccttaccccgaacgttaacggtaaaaccgttaaggtaacgggttcgggggtacgtttacggaaccgttaacgggtaacccggggg

SEQ ID NO: 303232 - DNA, 618 bp, Homo sapiens
  misc_feature: GZ8MTXP01DLFZH.10.87.H10.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtccaccatcacttggtcgggcagtcagcctatagcagctggtagcctggtatcagcaagagccgagggggacncccctaagcctctgatctatcgctgctatcctagtttgacgtaggtacggtcgggggtaaccccgtacgtaacgggttcagggtccgggacagggtcgggtatacggtaggggactaggttacttcgccttacctacctaaccctaatacccaaacctaaccgtgaccgacgtcccgttaggtacggttactttacgacttaaaccttactaactcgtacaaacgacggtctaagtcctacgtttaccccacgttccgtaacccgtttcccgggaccccggttaacggaaacggttcgggaacgtaacgtaaaaccggtacgttagtccggctaaccg

SEQ ID NO: 303233 - DNA, 675 bp, Homo sapiens
  misc_feature: GZ8MTXP01CGKDQ.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccaggccgtgggggtccctgagactctcctgtgcagcctctggtattcgacttcgaaatgtctggcagtgccacgtcgggtcccgccgaggcctaccgaacggaagggcgtgggagtgggtggctagtttctttcgagtttagaacgtaaggaaaaaagggtatattagtcgaccgtcccgtcggtaggaaacggggcctattaccgacgctactacctaccgtaagacgtaacttaacgtttaccgaaacggtcccgtaacggttcgtaactcgtaggaacctaaaggtcgtaaccctagacccgtaggtaaacgaaaggtacggaacgaaccgtaccgggtacttagttacgtaacgttagttggtacgaccgtaaacgtacccttacccgaaccgttaagtaaaacttagtaaggtacgggggtactttacggaacgttcggtaaccgggg

SEQ ID NO: 303234 - DNA, 556 bp, Homo sapiens
  misc_feature: GZ8MTXP01DJSN1.10.87.H10.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (413)..(413): a, c, t, g, unknown or other
  misc_feature (413)..(413): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgttgctctggctcccaggttccagatgcgacatccagatgacccagtctccatcttccgtgtctgcatctgtagganacagatcaccatcacttggcgggcagtcagcctattagcagctggtagcctggtatcagcagagccggagggggacnccccgtaagcctcctgatctatgctgctactcgtagtttcgcgaggtacgggtcggggtacccgtaacgtaacggttcgaggcgggacgtaggtggatcggtgggactagtattcgctctcacactacaacactncagcagggtagtatttcgactaacttcgtactgtacacgtagtctacgctaacgttcccacttccgttaccgttacccgggaccccggttaacgaaggttacgggtaacgtaaccgaaacggtactggttcggtcttcgaacc

SEQ ID NO: 303235 - DNA, 620 bp, Homo sapiens
  misc_feature: GZ8MTXP01DOQV4.10.87.H10.1.454.CMB.2.raw
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (439)..(439): a, c, t, g, unknown or other
  misc_feature (439)..(439): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccgaggccgtgggggtccctgacgactctcctgtgcagcctctggtattcgacttacgaaatgtctggcatgcacgtggtccgccaggctacgaacggaagggctgggagtgggtgctagtttcttcatttgactaggaaaaaaggatattanagcgctcgnggaacggcgattcgagcatctaccagacgactactttaccgaagtccacgggttntactcgtagacaaagttacgaaccacggaccgttaggaagtaaggtaggaacgaccgtaaccgggtacttagttgtaacttagttggtacggacgtaacgggtacccttaccgttacccgttaagtaaaccgttaagtgggttaccgggggtatttacggaacgttcgggtaacccggggg

SEQ ID NO: 303236 - DNA, 575 bp, Homo sapiens
  misc_feature: GZ8MTXP01C4YL4.10.87.H10.1.454.CMB.2.raw
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (412)..(412): a, c, t, g, unknown or other
  misc_feature (412)..(412): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagagacagagtcaccatcacgttgtcggcagtcagcctattagcagctggtagcctggtatcgagcagaagccgagggggacnccccgtaagctccngatctatgctgcatccgtagtttgacgaggtacggtcggggtaccctacgtaaggttcaggcggtacgagtggatcgtagggactaggtacttcgctctacaccataccaactaaccgngacgacgtacggtagtagttacttacgaacttaacttacgtacgtacgtacgaagtcgtactacgtaacctacgttccctacgttccgtacccggttacccgggaaccccggttaagttaacggtaacggaacgtaaccgaaacgtacgttcgtcgcgtaacg

SEQ ID NO: 303237 - DNA, 767 bp, Homo sapiens
  misc_feature: GZ8MTXP01CCSE3.10.87.H10.1.454.CMB.2.raw
  modified_base (203)..(203): a, c, t, g, unknown or other
  misc_feature (203)..(203): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatcgacccagtctcatcttccgtgtctgctatcgtgtagganacagatccactatcagttggtcgggcagtccagtccttattacgcgagtcgtcggtacgccgttaggtactcgagacgaaggacggcccggaagggggtaccctaccccgtaaggtcccttaccgtagtacttcgttaagtcgtaccgtcgtactacgttccgtaagtttcggacgtagggtacgggttccggggtaaccctagggtaacggttcgacgggaccggtcgtaggtacgggtacgtacgggtagggtaactaagtttcgtccggacttaccctaacgacccttaaactacccgtaaaaccgttccgtacggacctacggggtaccgttaagggtttaacggtttactttacccggaactttaaaccgttacgttaacgtaccgtaaacggtaaccgtacggtaccttacggtaaccccgttttacgttaccccgttaaaccgttcccggtttaaccccggttccccggggaaaccccgggttaaacggttaaacgggtaaccggtaaaccggtaaaccgttaaacgtcgggttacgtttccgggaactttaacccg

SEQ ID NO: 303238 - DNA, 624 bp, Homo sapiens
  misc_feature: GZ8MTXP01BS458.10.87.H10.1.454.CMB.2.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtcaccatcacgttggtcgggcagtcagcctattagcagtctggttagcctggtatcagcagacgccgagggggacncccctaagctctgatctatgctgctatcctagtttgcgtaggtacggtcggggtaccccgtgtaagggttcaggcggcagggtggactcgtaggggactaggtacttccgcttacctaccacctaacttaccgaaacctaacccgtgaccgtaacggtccggtaggtaagggttacttttacggaaccttaaaccttactacgttacgtaacctaacgacggtcctaacggtccttaacgtttccccgaaacttcccggtacccggtttacccggggacccccggttaacgttaacgggtcgggtacgtaacgaaaccggtacttggtcggttctaaccgg

SEQ ID NO: 303239 - DNA, 712 bp, Homo sapiens
  misc_feature: GZ8MTXP01CAQDV.10.87.H10.1.454.CMB.2.raw
tcagcatagtagtgcacgaccggtgctcgatttagcagtactgcgttgggtttgggggcaggagtcagacccagtcaggacacagcatggacatggacgggtccccgctcagctcctggggctcctgctgctctggctcccaggttccagatgcgacatccagatcgacccagtctccatcttccgtgtctgcatctgtaggagacagagtccaaccatcacgttggtcgggcagtcagcctagttagcagtctggttacgccgttaggtactcgagacgaaggaacggcccggaaaggggggaccaccccgtaacgcctccgtgtatacctatcgcttgctactcctagtttcgacgtaggtacggtccggggtacccgtacgtaacgggttcacgggccgggtacgacgggtgggtaacgtcggtaggggaactaggttacgtttccgcttaccgtaccctaacctaactaacccaaaaccgtaacccgtagaccgtaacgccggggttacggttaaaggggtttaccttttacgggaaaccctttaaaccgttaaccttaacgttacgtaacgtaaaccgtacggtactaacggtaaccttaccgtttcccctaacgttcccgttaaccggtttccccggaaccccgggttaaacgttaaacgggtaacgggaacgttaaccgaaacgacgttcgtaacgggcctaacg

SEQ ID NO: 303240 - DNA, 844 bp, Homo sapiens
  misc_feature: GZ8MTXP01AZJJD.10.87.H10.1.454.CMB.2.raw
  modified_base (265)..(265): a, c, t, g, unknown or other
  misc_feature (265)..(265): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtggggggtccctgacgactctcctgtgcagcctntggacttcgacttacgaaatgtctggcatgcacgtgggtcccgccgaggctaccgaacggaagggggctggggaggtgggtggctagtttctttcagttttagaagttaagggaaaaaaaggggtattaagtttagtacgacccggtaacccgttccgggtagggaaacgggggtccccgttaagtttaccgaaacgggaccctaacgttcccgtaacccgtaaagggtaaacgtaaacccgttaacgtttttaaccccggaaaacggggttaccccgtaaaccggggtttacggttaacttaccgttacggtaacctaaaacgggttaccggaaacccgaacgggtaccccgttaaggaaaacgggaaagggttacgggaaacggggaaccgtaaccgggggttaccttaaaggttcggtttaaaaccttgggtttacgggttacgggaaccgggtaaaaccggggttaccccctttacccggaaacccttaaacggtaaaaacccttaagggttaaccggggttaggggggggttaccttttacgggaaaacccggttccggggttaacccgggggg

SEQ ID NO: 303241 - DNA, 585 bp, Homo sapiens
  misc_feature: GZ8MTXP01C7JLL.10.87.H10.1.454.CMB.2.raw
  modified_base (262)..(262): a, c, t, g, unknown or other
  misc_feature (262)..(262): n is a, c, g, or t
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagccctntggattcgacttcgaaatgtctggcatgcactgggtccgccaggctccaacggaggggctggagtgggtggctagttcttcatttgataggaaaaaagggatattangcgaactccgagaagggccgtattcagcatctaccaganacatttaccgaaggtccacggtgtatcgtagacaaagtcgaccagacctagacgaagtgaaggacacggctagtgtaacttagttggtacgttcggaaacggtaccctttaccgaccgttagtaaaccttaaagtaacggtaggggggtcttttaggaacgttaacggtaacggggg

SEQ ID NO: 303242 - DNA, 690 bp, Homo sapiens
  misc_feature: GZ8MTXP01CYXR6.10.87.H10.1.454.CMB.2.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagacgtcaccatcacgttggtcgggnagtcagcctattagcagtctggttagcgtggtatcagcagacgccgaggggacacccgtaagctctgatctangctgacatccgtagtttgacgaggtacggtcggggtacccgtagtaacggttcgaaggcggacgagggtgggtacgtcggtacgggactacgggtactttcggcccttaccgtaccctaaaccctaacttaacccaaaaccgtaacccgtcggaacctaacggaccgggtttagggtaacgggtttaaattttaccggaacctttaaacttaccgttacgttacgtaaccgtaaacgacggttaccgtaacgttaacccgttaaccgtttaccccgaacgtttcccgttaaacccgggtttcccggggaacccccgggttaaacgttaaacggggttcggaaaccggttaaccgaaaacggtacgtttacgggtcggttccgtaaccg

SEQ ID NO: 303243 - DNA, 680 bp, Homo sapiens
  misc_feature: GZ8MTXP01BTEZI.10.87.H10.1.454.CMB.2.raw
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtcctccatcttccgtgtctgcatctgtaggagacagacgtcaccatctacgttggtccgggcgagtcagccttattagctagcgtgggttacgccgttggtatcgagacgaggaacggccggaacggggggaccaccccgtaaagccttaccgtgtacttctagtcgccttgactactccgtaggtttcggacgtaggtacgggttccgggggtaccccgttagtaacgggttcgagggtccgggacgtagggtggacgttcggtaggggactaggttactttccgccttactaccaaccctaactaacccgaaacctaccgtcgaccgagtcccggttaggtacgtttactttacgaaccttaaccgttacgtacgttagtacctaagtacggtactcgtcccttaccgtttacccacgttccgtacccggttacccgggaccccggttaaacgttaagggtccgggtaacggtaaccgtaaacggtacgttacggtcggccgtaaccg

SEQ ID NO: 303244 - DNA, 698 bp, Homo sapiens
  misc_feature: GZ8MTXP01D8F2P.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtgggtcccgccaggcctccgaacggaaggggctgggaggtgggtggctagtttctttcatttagaagtaggaaaaaaagggtaataattagtacgacgtaacccgtcgtaggaacgggtccgattcagcatctacagacgactatttacccgaagtaccacggtagtactacgtagacctaaaggtcgaaccgacgtacccgtaggaagaaaggttaggaaacgggaccgtaacgggtaccttaagttagggttaaccttaacgtttggtacggttaaccgggtaaaccggttaccccgtttacccgaacccgtttaaacggtaaaaccgtttaaacggtaacgggtttacgggggggttacgtttaacgggtaaacccggttaacggggttaaccccgggggg

SEQ ID NO: 303245 - DNA, 739 bp, Homo sapiens
  misc_feature: GZ8MTXP01ACCPY.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggcttcttttaggaggtgcccagtgtcaagtgcagcgtggtggagtcgtgggggaggcgtggtccaggccgtgggggtccctgacgactctcctgtgcagcctcgtggattcgacttcgaaatgtctggcatgcacgtgggtcccgccgaggcctaccgaacggaagggggctgggaggtgggggtaggtctaggtttctttactagtttggaaactaaaggaaaaaagggtattaaattagtacggtaccgtaacccgttcggtaagggaaacggggtaccgtaatttcgaagtacctacttccgtaccgacggtaacgtaaccttacgtttacccgaacgggtacccgtaacggggttacgtactttcgtacgaaccgtaaaacgggttcgaaacccgtacgacccggttaaggaaaggtaacggaggtaacggaaccgacgggtacttacgtgttaacttaagttcgggtacggaacggtaaaccggttaccccttaccgaacccgttaagtaaaaccgttaaggtaaggggttacggggtaccgtttaggaaccgttaacgggtaaccggggg

SEQ ID NO: 303246 - DNA, 746 bp, Homo sapiens
  misc_feature: GZ8MTXP01DTNPY.10.87.H10.1.454.CMB.2.raw
  modified_base (205)..(205): a, c, t, g, unknown or other
  misc_feature (205)..(205): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgaccccagtcctccattcttccgtgtctgcatctggtagganacagagtccaaccattcacgttggtcgggacgagtccagccttattagcagctggttagtcgtggtatnagcagagccgagggggacnccctaagcctctgatctatcgctcgcacgttcctaggtttcgacggtaaggtcgggttacccgggggtaccccgttagtaacgggtttcgaacgggtccgggtacgtagggttcgggtaagttcgggtacggggtaactacggtttaacgtttccggtacccttaccttaacccaaacccgttaaaccttaacccggaaaaccccttaaaccccgttggaacccgtaaccgggttacccggggtttaggttaaacggggttttacttttaacggtaacccgttaaaccgttttaacgtaacttacgttaaccgaaaagtccgggtacctaaggtcccttaacgtttaccccgtacctttaccgtaccccggtttaaccgggacccccgggttaagttaaacgggtcgggtaaaaccgtaacgaaaacgggtacttagggtcgaacgttaaccg

SEQ ID NO: 303247 - DNA, 714 bp, Homo sapiens
  misc_feature: GZ8MTXP01EYS9G.10.87.H10.1.454.CMB.2.raw
  modified_base (320)..(320): a, c, t, g, unknown or other
  misc_feature (320)..(320): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttggctgagcgttgggttttcctggtggcttcgttttaggaggtcgcccagtgtacaagtgcagctggtggagtcgtggggagcgtggtccgaggccgtgggggtccctgacgtactctccgtgtcgcgacgtcctcgtggtacttcgacttacgaaagtgcgtggcatgctacgtcgggcccncgaggtcctaccgaaacggaggggctgggagttcggggcgtctagtttctttcgtagtttaggaacgtaaaggaaaaaaggtatatagtcgacgtccgcgtaaggacgggccgtattaccgagactactcacgtaaggctaacgtactttaacccgaacggtacccgtaaggttacgtagttaccgttacggaaaccttaaacgggtaccgtaacccggtaacgtaccccgggttaaagaaggtaaaccgggttaggaaaccgggttaaccgacgggtaaccttagtaacgggttaaccttaacgttaggtacgttaacggtaaacgtacccttaccgttagttacgtaaactagtaacggtacgggtacttagtaacgttaacgggtaacggg

SEQ ID NO: 303248 - DNA, 769 bp, Homo sapiens
  misc_feature: GZ8MTXP01DUH6B.10.87.H10.1.454.CMB.2.raw
  modified_base (310)..(310): a, c, t, g, unknown or other
  misc_feature (310)..(310): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
  modified_base (600)..(600): a, c, t, g, unknown or other
  misc_feature (600)..(600): n is a, c, g, or t
tcagcatagtagtgcacgaccggtgctcgatttagcagtactgcggttggggtttgggggggagaggagcccagcactagaagtcggcggtgtttccattcggtgatcagcagtgaacacaaaggactcaccatggagtttgggctgagcttgggttttcctggtggctcttttaggaggtgcccagtgtcaagtgcagcgtggtggagtcgtgggggagcgtgggtccaggccgtgggggtccctgacgctctctgtgcagcctcgtgattcgacttacgaaatgtctggcagtcgctacgtgggcccncgaggcctaccgaacggaaggggctgggaggtgggtgtctagtttccgttanagtttagaacgtaaaggtaaaaaagggtnttaatacgtaacgaccgtaacccggtacggttacgggaaacggggtccctaagttaccgaggtacctaaacgttcctaaccgaaggtaaccggtaacttaaacgttttaacccggaaacgggtaccgtaaccggggtttagtaaccttagaccggtaaactaaacggttaccggaaacgtaaccgacccgttaggaaacggttaaacgnggtaaaccgggaacgtaccgggtacttaacggtagttaaccgttaagttagggtaccgttaaaccgggtaaccggtaacccttaccccgttaagttaaaccggttaaaacgtaagttaaccggggttagggggtaccctttagggtaaccggttcggtaacccgggggg

SEQ ID NO: 303249 - DNA, 688 bp, Homo sapiens
  misc_feature: GZ8MTXP02ICKT2.10.87.H10.1.454.CMB.2.raw
  modified_base (483)..(483): a, c, t, g, unknown or other
  misc_feature (483)..(483): n is a, c, g, or t
  modified_base (528)..(528): a, c, t, g, unknown or other
  misc_feature (528)..(528): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtcctgctatcgtaggtaggagacgagtacgtaccaacctatacctacgttcggggtccgggacgtacgtacgaccgtacctttaagttacgcgacgtcggtttaggtacctccggttaggtactcgagacgaaaggaccgaccggggaagggggaccctaccccgtaagtcccttcgtagtacttacgtagtcgctcgactactaccgttagttcgacgtaggtacggggttcccggggttacccctaggtacggttccgacgggccggacgtagggtaggtacttcgggaccgggganaggtttcgttccgacctctaccaacctactaaccaaaccctacgngaccgacgtccgaggtaagtttactttacgaaccttaaccttactacgtctaaccgaagacgtactacgactttacccgttcctacttccgttaccggttcccgggaccccgtaaagtaacgggtcggtacgtaaaccgaaaacgtcgtggacgtacgcg

SEQ ID NO: 303250 - DNA, 749 bp, Homo sapiens
  misc_feature: GZ8MTXP02I5W28.10.87.H10.1.454.CMB.2.raw
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctaggtaggacacgagactaccactactactacgttcgggtcgggacgtacgtcgacgtaccttaagttacgacgacgtcgttaggttaccgccggttaggtactacgagacgaaaggaaccgccggggaaggggggacccctaccccgtaacggtccccttaccgtaggtacttacctagtccgtcgtcgactacttaccgttaggtttcgacgtaggtacggggttccggggttacccccgtaaggttacggggttacgacggggcggtaccgtaggggtacggtacttcgggtacggggaactagttacgttccgcttctaccacctactaaccaaacctacgtcgacgtacgtccgtaggtagtttacgtttcgaaccttaaacctttactacgtacgttaaccaacggtacggtacttaacgtaccggtttacccgttaccccacgttacccgttaccggtttacccccggggaacccccggtaaaccgtaaagggtaacggggtaaccgtaaaccgaaaaccggtacgtttagggtaccgtcggttaacccg

SEQ ID NO: 303251 - DNA, 520 bp, Homo sapiens
  misc_feature: GZ8MTXP02HJTZY.10.87.H10.1.454.CMB.2.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagatcaccatcacttggtcgggcagtcagcctattagcagctggtagcctggtatcagcagaagccgagggggacncccctaagctcctgatctatgctgcatccagtttgcagagtggggtccctnaggttcagcggcagtgatcgngggacagattcgctctcaccatacaaacaacctgacaggtcctagtaggtattttacgactaaacttactaacgtgtacaaanaggactagctacgtttcccacttctaacctttccggacccggtaaccgaaaggtcggaaggtacaaaacggaacttgacggctacg

SEQ ID NO: 303252 - DNA, 513 bp, Homo sapiens
  misc_feature: GZ8MTXP02I1ZVY.10.87.H10.1.454.CMB.2.raw
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgcgggcagtcagcctattagcagctggttagcctggtatcagcagagccaggggacnccctaagctcctgatctatgctgcatccagttncagagtgggtccgtnaggttcagcggcngtgatcgtgggacagtattcgctctacaccatccaaacaacctgaccaagccgtagaggtatttcgactaacttactactgtacaaacaggtctacgtctacgtttcccacttcctaaccgtttccgggaccccggacaaaaggtcggaaggtacaaacgtatcggtacggctacg

SEQ ID NO: 303253 - DNA, 525 bp, Homo sapiens
  misc_feature: GZ8MTXP02HR2UR.10.87.H10.1.454.CMB.2.raw
  modified_base (183)..(183): a, c, t, g, unknown or other
  misc_feature (183)..(183): n is a, c, g, or t
  modified_base (277)..(277): a, c, t, g, unknown or other
  misc_feature (277)..(277): n is a, c, g, or t
  modified_base (385)..(385): a, c, t, g, unknown or other
  misc_feature (385)..(385): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgngtctgcatctgtaggagacagagtcaccatcacttgcgggcagtcagcctatagcagctggttagcctggtatcagcagaagccgagggggacncccctaagctcctgatctatgctgcatccagtttgcagaggtggggtcccgtgaggttcagcggcgagtggatcgtgggacagatttcgctctcaccatcaaacactnacagcctgagtattttcggactaaacttactactacgtacaaacgaggtactaagctaacggtttcccaacttccgtaaccgtttccgggaccccggtaacaaacggtcggacggtacgaaacgaactcggacggactcg

SEQ ID NO: 303254 - DNA, 591 bp, Homo sapiens
  misc_feature: GZ8MTXP02ITAFD.10.87.H10.1.454.CMB.2.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (435)..(435): a, c, t, g, unknown or other
  misc_feature (435)..(435): n is a, c, g, or t
tcagcatagtagtgcacgaccggtgctcgatttagcagtactgcgttgggtttggggcaggagtcagacccagtcaggacacagcatggacatggacgggtccccgctcagctccgtggggctcctgttgctctggctcccaggttccagatgcgacatccagatgacccagtctccattccttccgtgtctgcatctgtaggagacagagtccaccatcacgttggcgggcagtcagcctatagcagctggtancgtgtacncagnagacgcgaggggacncccgtagctctgatctatgctgctattccagttcgcgaggacggtcggggtacctgaaggttcgacgtcggcgagtggacgtcgtagggactagtatttcgcctactacaccactacaaaccaacctcgacctacggccgttagtacggttanaactttttaggaccaaacgttttcaaaccctagggtctaaaacctgggctttaacggtcccaaggttttcccccaacgtttcccgggaccctttaacgaccccgggggactaaaaggtccggaaaacggttcaaacggggactcgtacggacctcg

SEQ ID NO: 303255 - DNA, 749 bp, Homo sapiens
  misc_feature: GZ8MTXP02JOK1F.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccagccgtgggggtccctgagactctcctgtgcagcctctggattcgacttcgaaatgtctggcatgcacgtcgggtccgcaggctaccgaacggaaggggctggaggtggggtggctagttcctttcagtttagaagtaaggaaaaaagggtaattagttatcggacgtacccgtcggtacggaacgggccgattcgagtccatcctaccgagacgaactaacgtttacccgaaacgggtcccgtaacgggttacggttaacttaccgttacgggaacctaaaacgttaccggaaacccgtaaccgggtaccccgttaaggggtaaacgggaaacggggttaggggtaaaacggggaacccggtaaaccgggggttacccttaaacggttagggttaaaccgtttaaggtttacgggttacggtaaccgggtaaaaccgggtaacccctttaaccccgtaaaccggttaacggtaaaaaccgtttaaaggttaacggggttacggggggtttaaacccgg

SEQ ID NO: 303256 - DNA, 550 bp, Homo sapiens
  misc_feature: GZ8MTXP02HO1W4.10.87.H10.1.454.CMB.2.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgngtctgcatctgtagganacagatcaccatcacttggcgggcagtcagctatagcagctggtagcctggtatcagcagagccaggggacgcccctaagctcctgatctatgctgcatccagtttgcagaggtggggtcccctgacggttcagcggcaggtggatcgtgggacagtactttcgctctacaccataccaacaacctgaccacgtcctaggtaggtattttagacctaaacttactactcgtacaacgaggtctaagcctaacgttttcccacttaccgtaccgtttccgggacccccgggtaacaaacggttaacgggaacggttaaccgaaaacggtaacgtcggtacggtcctacgg

SEQ ID NO: 303257 - DNA, 506 bp, Homo sapiens
  misc_feature: GZ8MTXP02IV4LV.10.87.H10.1.454.CMB.2.raw
  modified_base (277)..(277): a, c, t, g, unknown or other
  misc_feature (277)..(277): n is a, c, g, or t
  modified_base (331)..(331): a, c, t, g, unknown or other
  misc_feature (331)..(331): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggtagcctggtatcagcagagccgagggggancccctaagctcctgatctatgctgcatccagtttgcaggagtcggggtcccgtnaggttcaggcggcagtggatcgtagggacagatttcgctctcaccatacaacactgacagcctgaggtatttgactaacgttactactgtacaacgaggctagtctacgtttcccactcctacgtttcccggacccggtaacaaaggtggacgtacaaacgactcgtcggctacg

SEQ ID NO: 303258 - DNA, 563 bp, Homo sapiens
  misc_feature: GZ8MTXP02HIMJY.10.87.H10.1.454.CMB.2.raw
  modified_base (282)..(282): a, c, t, g, unknown or other
  misc_feature (282)..(282): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttggtcgggcgagtcagcctattagcagctggttagcctggtatcagcagaagccgagggggacncccctaagctcctgatctatgctgcatccagtttgcaggaggtcggggtcccgtagagggttcaggcggcgaggtggatcgaggacagtattcgctctcaccatcaacactgacagtcctgtacgttatttacgacttaacttactactgtacaagtaggactagtacctacgtttccccaccttaccgtacccgtttacccggggacccccgggtaaaccgtaaacgggtccggtaaacggtaaccgaaaaccggtaacgtcggtacgggtacctaccgg

SEQ ID NO: 303259 - DNA, 489 bp, Homo sapiens
  misc_feature: GZ8MTXP02JEYMY.10.87.H10.1.454.CMB.2.raw
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
tcagcatagtagtgcacgaccggtgctcgatttagcagtactgcgttgggtttggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccagggggancccctaagctcctgatctatgctgcatccagtttgcagagtggggtcccgtnaggttcagcggcagtggatctggggacagatttcgctctcaccatccaacacctgcagcctgaggtattttggacaacttactactgtcaagaggctagctagtttcccactcacgtttcgaccccggacaaagtcggagtacaacgactgtacggctcg

SEQ ID NO: 303260 - DNA, 561 bp, Homo sapiens
  misc_feature: GZ8MTXP02JMF5W.10.87.H10.1.454.CMB.2.raw
  modified_base (273)..(273): a, c, t, g, unknown or other
  misc_feature (273)..(273): n is a, c, g, or t
  modified_base (325)..(325): a, c, t, g, unknown or other
  misc_feature (325)..(325): n is a, c, g, or t
tcagcatagtagtgcacgaccggtgctcgatttagcagtactgcgttgggttggggcaggagtcagacccagtcaggacacagcatggacatgagggtcccgctcagctcctggggctcctgctgctctggctcccaggttccagatgcgacatccagatgacccagtctccatcttccgtgtctgcatctgtaggagacagagtcaccatcacttgcgggcagtcagcctatagcagctggttagcctggtatcagcagaagccagggggancccctaagctcctgatctatgctgcatccagtttgcagagtggggtcccgtnaggttcagcggcagtggatcgtgggacagattcgctctcaccatcaacacctgcagcctagaggtattttcgactaaacttactactgtacaaactaggactaggacctacggttttaccccacttacccgtaaccgttttacccggggaccccccggggtaaaccgtaaaacgggtcggggtaaacggttaacccgaaaaacggtaaaccgttcggttaacggggccttaaccgg

SEQ ID NO: 303261 - DNA, 588 bp, Homo sapiens
  misc_feature: GZ8MTXP02FTGM2.10.87.H10.1.454.CMB.2.raw
  modified_base (379)..(379): a, c, t, g, unknown or other
  misc_feature (379)..(379): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcactgggtccgccaggcctccgaacgaaggggctgggaggtggggtggcgtagtttctttctatttgaataggaaaaaaggtaatattangcgcctccgtagaaggccgattcagcatctccagagactatttaccgaacggccaacggttgtaactctaggactaaagtcgaaccgacgccgtagaacgaagtaggaggacgacggtactagtagtaactagttgtacgacggaacgtacccttaccaccttagaaaacttaataaggtcgggggtactttaggaacacggtacgggg

SEQ ID NO: 303262 - DNA, 594 bp, Homo sapiens
  misc_feature: GZ8MTXP02I45DS.10.87.H10.1.454.CMB.2.raw
  modified_base (258)..(258): a, c, t, g, unknown or other
  misc_feature (258)..(258): n is a, c, g, or t
  modified_base (381)..(382): a, c, t, g, unknown or other
  misc_feature (381)..(382): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagcgtggtttccgtggtggctctttaggaggtgcccagtgtcaagtgcagctggtggagtcgtgggggagcgtggtccagccgtgggggtccctgagctctcctgtncagcctctggattcgacttcgaaatgtctggcatgcacgtgggtccgccgaggcctaccgaacggaaggggctgggaggtggggtgctagttccgtttcatttgaataggaaaaaggatatannccgacctcgtaggaacggccatcagcatcctacccaggacaactacgttaccgaaacggacccgtaaggttgttaactccttaggaaccttaaaagtacggaaccaaacgccgtaggaacgtaacggtggaaacggacgtacggacttagtcgttaaactgttgtacgcgaacggtaacctccgaactaggaaactagtaggtacggggtac

SEQ ID NO: 303263 - DNA, 559 bp, Homo sapiens
  misc_feature: GZ8MTXP02IXYGA.10.87.H10.1.454.CMB.2.raw
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagccctattagcagctggttagcctggtatcagcagaagccagggggacnccccgtaagctcctgatctatgctgcatccagtttgcagaggtggggtccctcgagggttcaggcggcagtggatcgtgggacagtacttcgctctacaccatacaaacaacctgacacgcctaggtaggtattttggacctaaacttactactcgtacaaaccgaggtactacgtactacggtttcccacttaccgtaccgtttcccgggacccccgggtaactaaaacgggtcgggaacggtaacctaaaacggaacgtacggtacggactaccgg

SEQ ID NO: 303264 - DNA, 590 bp, Homo sapiens
  misc_feature: GZ8MTXP02JHGAS.10.87.H10.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtcacatcacttgtcgggcagtcagcctattagcagctggtagcctggtatcagcagaagccgagggggacnccccgtaagcctcctgatctatgctgcatccagtttgacgtagacgggttcggggtcccgttagtacgggttcgaaggcgggacagggtggatcgtaggggacaggtactttcgcttctaccaccataccaaacacctgaccagtccgtaggtaggttattttacgacctaactttactacgttcgtacaacgaggtactaacgtcctacgtttacccacgttccgtaccggtttcccgggacccccggtaacgtaaacggtcggggtaaacggtaaccgaaaaccggtaacgttacggtacggactaccgg

SEQ ID NO: 303265 - DNA, 520 bp, Homo sapiens
  misc_feature: GZ8MTXP02GN4VF.10.87.H10.1.454.CMB.2.raw
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgttgctctggctcccaggttccagatgcgacatccagatgaccccagtctccatcttccgtgtctgcatctgtaggagacagagtcaccatcacttgtcgggcgagtcagcctattagcagctggtagcctggtatcagcagaagccgaaggggacncccctaagctcctgatctatgctgcatcctagtttcgacaggtaggtcggggtccccgtacgaaagggttcaggcggcgagtggaatcgtggggacagtatttcgctctcaccatacaaacacctgcagcctagaggtatttgacctaaacttactactgtacaaacgaggctagctacgttcccactcacgttccggacccgaacaagtcggaagtacaaacgactgtcgctacgacc

SEQ ID NO: 303266 - DNA, 717 bp, Homo sapiens
  misc_feature: GZ8MTXP02H3K20.10.87.H10.1.454.CMB.2.raw
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaacctatcacgttggcgggcgagtcagcctatagcagctggtagcctggtatcagcagaagccgaggggacncccctaagctccgtgactctatgctcgctatcctagtttgactaggagggttcggggtacccgtacgtaagggtttcgaaggccgggtacgtaaggtcgggaacttccggtacggggaaccaggttacgtttccggcctcccttacctaaacctaacttaaacccaaacctaaccgttacgaccgtaacggtcccgttagggttaacggttaacttttacgggtaacccttaaaacgtttaaaccttaacgttacggttaaccaaaccgtaacggtaccgtaaaacggtcccgttaaaccggttttacccctaacccgtttacccggtacccggttttaccccggggaaccccccgggtaaaaccgtaaaacggggttaaccgggtaacggttaaaccgaaaaccggtaaccgttcggtacgggttacctaaccgg

SEQ ID NO: 303267 - DNA, 689 bp, Homo sapiens
  misc_feature: GZ8MTXP02IM1RQ.10.87.H10.1.454.CMB.2.raw
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtcggggtccgccaggcctaccgaaacggaaggggctgggaggtggggtggctagttcttnatttgatagaaaaaggatatangcactcgngaacgggccatcagcatctaccagacgactatttaccgaacggtccacggttgtaactcttagaacctaaaagtcggaaaccctaggcccgtaaggaacggaaagtcgggaacggaaccgacggggtactaagttacggttaaacttaagtttcgggtacggtaaacccgggtaaaacgggttaccccctttaaccccgtaaacccgtttaaacggaaaaaacccgtttaaaacggttaacgggggttaccgggggggttaacctttttaaacgggaaaacccgtaacggggtttacccgggggg

SEQ ID NO: 303268 - DNA, 501 bp, Homo sapiens
  misc_feature: GZ8MTXP02F4PCN.10.87.H10.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagatcaccatcacttgcgggcagtcagcctattagcagctggttagcctggtatcagcagaagccgagggggacncccctaagctctgatctatgctgcatccagtttgcaggngtggggtccctgaggtcaggcgnagtggatcgngggacagtatttcgctctcacatacaaacaacctgacacgcctagagtatttacgactaaacttactactgtacaacaggctagctacgttccactctacgtttccggacccggacaaacggtggaacgtacaaacgagtcgtacggctcg

SEQ ID NO: 303269 - DNA, 618 bp, Homo sapiens
  misc_feature: GZ8MTXP02GWKMU.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtaaagtgcagctggtggagtcgtgggggaggcgtggtccagccgtggggggtccctgagactctcctgtgcagcctctggattcgacttcgaaatgtctggcatgcactgggtcccgccaggcctcccgaacggaaggggctgggaggtggggtggcgtagtttctttctatttgaataggaaaaaagggtataattatgccgacctccggtgaaagggccattcagcatctccagagacactttacccgaaggcccacggtgtatctagacaaatgaccagcctagagaagtgaggacacggctagtgtaacttagtcgttagaccgtaaacgggtacccttacccgaaccgtaacgtaaaaccgtaaagttaacggttaacggggggtaccttttacggaaaaccgtaccgggttacgggggaaccccggg

SEQ ID NO: 303270 - DNA, 536 bp, Homo sapiens
  misc_feature: GZ8MTXP02GG6TP.10.87.H10.1.454.CMB.2.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (382)..(383): a, c, t, g, unknown or other
  misc_feature (382)..(383): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagcgtggtttcgtggtaggctctttaggaggtgccagtgtcaagtgcagctggtggagtcgtgggggagcgtggtccagccgtgggggtccctgagactctcctgtgcagcctntggattcgacttcgaaatgtctggcatgcacgtggtccncaggctaccgaaggagggctggagtgggtgctagttctnatttgatagaaaaaggntagtatgctactcgtgaaggccagttcannactcacananactactacacgacgagtgtatctanacaatacgacacgacgagagagagagacgacgagtagtagtactagtagtacgtacgtacgtacctacctactaacgtaaacgtaagtacggtacggtacgtacgtacgacggtacgg

SEQ ID NO: 303271 - DNA, 722 bp, Homo sapiens
  misc_feature: GZ8MTXP02ICWE2.10.87.H10.1.454.CMB.2.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtcaccatcacttgcgggcagtcagcctattagcagctggtancctggtatcagcagagccgagggggacncccctaagctcctgatctatgctgcatccgtagtttcgacgaggtacggttcggggttacccccgttacgtaacggggtttccgaaggtccggggacgtagggtcgggtaattccgggtaggggtaacgaggttacgtttcggcctttaccctaccaacctaactaacccaaaaccctaacccgtcgaaccgtacgtacccgttagggtaacgggtttactttttaccggaaccttaaaaccgtttaaccgttaaccttacggtttaaccaaaaccggtacggtaccgttaaacggtaccctttaaaccggtttcccccgtaaactttaccccgttaacccgggttttacccccgggaacccccgggggttaaaaccctaaaacgggggttaacgggtaaacgggtaacctaaaaccggtaacgtttcggtacggtaccgtaccg

SEQ ID NO: 303272 - DNA, 643 bp, Homo sapiens
  misc_feature: GZ8MTXP02I9TLP.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtcgggtcccgccagggcctacccgaaacggaaggggctgggaggtggggtggctagtttctttcagttttagaataaggaaaaaagggtattaagttataggaccgtacccgtccggtaggaaacggggccgtaattcgaagctactctacccgagaacgactaacgtttacccgaacggaccctaacggttagtactcgtagacctaaagtacgaaccacgaccgtagaagaagtagaaggaacgacggatagtgtaacttagttagtcgacgtaaacggtacccttaccgaacctaagtaaaccgtaagtaacggtagggggtactttacggaacgtacgtacgggg

SEQ ID NO: 303273 - DNA, 565 bp, Homo sapiens
  misc_feature: GZ8MTXP02IOVY2.10.87.H10.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtcaccatcacttgtcggtcgagtcagcctattagcagctggttagcctggtatcagcaagagccgagggggacncccctaagcctctgatctatgctgcatcctagtttgcaggtaggtcggggtacccgtcgtagggttcaggcggcaggtggatcgtggacagtattcgctctacaccataccaaacacctgacacgcctaggtagtattttcgacctaactttactacttgtacaacgtaggactaacggtctacgtttacccacgttaccgtacccgtttacccggggacccccggtaacgtaaaacggttcggaaacggtaccgtaaaacggtacgtacggtacggacgtacg

SEQ ID NO: 303274 - DNA, 531 bp, Homo sapiens
  misc_feature: GZ8MTXP02HV902.10.87.H10.1.454.CMB.2.raw
  modified_base (308)..(308): a, c, t, g, unknown or other
  misc_feature (308)..(308): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgagactctcctgtgcagcctctggattcgacttcgaaatgtctggcatgcactgggtccnccaggctccgaacggaaggggctgggagtggggtggcagttcctttcatttgatagaaaaaagggatattatgcgacctcgtgaagggccattcagcatctccagagacattccgaagccacggtgtatctgacaaatgaccagcctgagaagtgagacacggctatgtactattcgtagcgaaggtcccttacacctagaaaactaagtagtacgggggtac

SEQ ID NO: 303275 - DNA, 716 bp, Homo sapiens
  misc_feature: GZ8MTXP02HPY3P.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtgggggtccctgagactctcctgtgcagcctctggattcgacttcgaaatgtctggcatgcacgtgggtcccgccaggcctaccgaaacggaaggggctaggggagtggggtggctagtttctttacgattttagaataaaggaaaaaaggtattagttatcggacgtaccctccgggttaggaaacggggcccgtaaattccgaagtaccctacttaccgtacccgaagaacgtaactaacgttttacccgaaacggtcccgtaaacgggttcgttactccgttagactaaaacgtcgaaccagtacccgtagaacgaaaggtacggaacggaccgaacggtaccttaagtacggttaaccttacgtttggtaacgtaccggtaaaacggttaccccgttaccctaaacccgtaaggttaaaaaccgttaaggtaacgggtacgggggttaccttttacggaaaccgttacgggtaacccggggg

SEQ ID NO: 303276 - DNA, 651 bp, Homo sapiens
  misc_feature: GZ8MTXP02G5WPS.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgagactctcctgtgcagcctctggattcgacttcgaaatgtctggcatgcacgtgggtccgccaggcctaccgaacggaaggggctgggacggtggggtggcgtagttcctttacattttagaagtaaggaaaaaaggggtattagtttatcggaccgtacccgttccgggtaggaaacggggcccgtattcgagcaactctcccgaagacgactactttaccaacggtcctacggtgtatcgttagactaaagtcgaaccagtaccgtaggaaggaacggtaggaacggacgtaacgggacttagtacgttaacttaagtttcggacggtacggtaaacggtaacccttacccgtaaccgttaacgtaaaaccgttaagttacgggtacgggggtttaaccg

SEQ ID NO: 303277 - DNA, 643 bp, Homo sapiens
  misc_feature: GZ8MTXP02JEVN7.10.87.H10.1.454.CMB.2.raw
  modified_base (283)..(283): a, c, t, g, unknown or other
  misc_feature (283)..(283): n is a, c, g, or t
  modified_base (338)..(338): a, c, t, g, unknown or other
  misc_feature (338)..(338): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttggtcgggcgagtcagcctattagcagctggttagcctggtatcagcaagaagccgagggggacnccccgtaagctcctgatctatgctgcatccagtttgcagtaggtcggggtaccgngaggttcagcggcgaggtggactcgtaggggactaggtactttcgcttctccaaccctaagtaccaaacctaaaccctgaccgacgtacccgttggtaacggggttatttttacgggaaccttaaaacgtttaaccttaacgttacggttaaccaaaccgtacgggtacttacggtacccttacggttttacccctaacttcccgttaaccggttttaccccggggacccccgggtaaaccgaaaacggggttcggtaaacggttaaccgaaaaccggtaacttacggttacgggtcttaaccgg

SEQ ID NO: 303278 - DNA, 527 bp, Homo sapiens
  misc_feature: GZ8MTXP02ITCD3.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggagcgtggtccagcctgggggtccctgagactctcctgtgcagcctctggattcgacttcgaaatgtctggcatgcactggtccgcaggctccaacgaaggggctggagtgggtggcagttctttcatttgatagaaaaaggtatattatgcgctcgtgaagggccattcagcatctccagagacatttccaaggccacggtgtatctgacaaatcgaccagcctagacgagtgagacacggactagtgtactattgtcgacgaacggtaccttaccactagaaactagtagtcgggggctttacgactacgtcgg

SEQ ID NO: 303279 - DNA, 550 bp, Homo sapiens
  misc_feature: GZ8MTXP02FWLZB.10.87.H10.1.454.CMB.2.raw
  modified_base (279)..(279): a, c, t, g, unknown or other
  misc_feature (279)..(279): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcagaagccgaggggacncccctaagctctgatctatgctgcatccagtttgcagtacgtcggggtcccgtcgagggttcaggcggcaggtggatcgtagggactagtattcgctctcaccatacaacacctgacacgcctagtagtactttgacttaaccttactactgtacaacgtagctacgctacgtttcccacttaccgtaccgtttacccggggacccccgggtaactaaacgggtaacggtaacggttaaccgaaaacggaacgttcggtacggccttacgg

SEQ ID NO: 303280 - DNA, 732 bp, Homo sapiens
  misc_feature: GZ8MTXP02JL2AU.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtggggggtccctggagactctcctgtcgcagcctctggattcgacttcgaaatgtctggcatgcacgtcgggtcccgccaggcctccgaaacggaacgggggctggggaggtggggtggcgtaggtttccctttctatttgaattaggaaaaaaagggtattagttatcggaccgtaccgtaccgtaggaaacgggtcccgtaagttcaggacctaatcctacccgaagtacggtaactacgttttaacccgaaacgggtccccgtaaacggggtcgttaaacgtccgttacggaccgtaaaaagttccgaaacccgaggaccccgttaaggaaggtaaacggtagggaaacgggaaccgtaaccggggtctttaaagtacgggttaaaccttaaagtttcggtacggtaccggtaaaacgggtaaccccttaacccgtaaacccccgttaaggtaaaaccctttaaacggtaacgggttacggggggtttaacc

SEQ ID NO: 303281 - DNA, 587 bp, Homo sapiens
  misc_feature: GZ8MTXP02G0KMZ.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgccagtgtcaagtgcagctggtggagtcgtgggggagcgtggtccagccgtgggggtccctgagctctcctgtgcagcctctggattcgacttcgaaatgtctggcatgcactgggtccgcaggctccgaacgaaggggctgggaggtggggtggctagtttctttcgatttgaatagaaaaaagggatatatcgacgacctcgtaggaacgggccgtattcgagcatctccgagacgactactttaccgaaacggcctaacggtatatctagacaaagttcgaccagcctaggaagaaggtacgaggacacggactagtagtactagtgtacgacgtaacgtaccgttaccaacgtagtaaaccgtaagtacggtacggggtactttacggaacgtacggtaccgggg

SEQ ID NO: 303282 - DNA, 640 bp, Homo sapiens
  misc_feature: GZ8MTXP02IT0KF.10.87.H10.1.454.CMB.2.raw
  modified_base (425)..(425): a, c, t, g, unknown or other
  misc_feature (425)..(425): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagcttgggttttcctggtggctcttttaggaggtgcccagtgtcaagtgcagctggtggagtcgtgggggagcgtggtccagccgtgggggtccctgagctctcctgtgcagcctcgtggattcgacttcgaaatgtctggcatgcacgtcgggtcccgccaggcctaccgaaacggaaggggctggggaggttgggtggtctagtttctttctagtttagaagtaaaggaaaaaaggtattagttatcgacgtccgtcgtaggaacgggcctattcgancactctaccagagaactaacgtttaccgaaacggtccctacgggttatacgtctaggaacctaaagcgtacacgccgtaagagaagtaggacgacgacggtactagtcgttactagttaggtacgaaccgtaaacggtaccctaaccgtaacccgtaaagtaaaccgtaagttaacgggtacggggttacttacggaacgtaccggtaccggggg

SEQ ID NO: 303283 - DNA, 775 bp, Homo sapiens
  misc_feature: GZ8MTXP02JIF15.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagcttgggttttcctggtggcttcgttttaggaggtgcccagtgtcaagtgcagctgggtggagtcggtgggggaggcggtgggtccgaggtcccggtcgggggggtcccctggacgtaccttccgttcccgtggtcgccgacgtccctcgtggtacttcgtacttacgaaatgtctggctagtgcacggtcgggtcccgccgacggccgtaccgaaacgggaacggggtcgtaggggaggttggggtcggtcgttacgtttcctttacgtagtttagtaaagtaaggtaaaaaaaggtattagttagtcggaccgtaccgtacggtaggaacgggccgtagttacgacgtactacgtacctaccgagtaacgtaacgttacgtttaacccggaacggtacccgttacgggttacgttacgttaccgttacggtaaacctaaacggtaccgaacccgtacgtaccggttaaggaaacggtaaggtacgggaaacgggaaccggtacggtaccgttaagttacggttaacgttaggttacgtaaccggtaaccgtaaaccggtaacccttaacccgtaaacgttaaacgtaaaacgttaacggttacgggtacggggtttaaccg

SEQ ID NO: 303284 - DNA, 611 bp, Homo sapiens
  misc_feature: GZ8MTXP02JDPGR.10.87.H10.1.454.CMB.2.raw
  modified_base (227)..(227): a, c, t, g, unknown or other
  misc_feature (227)..(227): n is a, c, g, or t
  modified_base (281)..(281): a, c, t, g, unknown or other
  misc_feature (281)..(281): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttggtcgggngagtcagcctattagcagctggttagcctggtatcagcagagccgagggggacnccccgtaagctcctgatctatgctgcatcctagtttgcaggtacggtcggggtcccgtagtacgggttcacgggcgcgaggtaggagtacgtagggactaggtactttcgactctccacctactaccaaacactcgacgtaacgtccgtaggtacggttacttttacggaccttaaactttacgtacgtacgttaacgaacgtacggtactaacgtaccgttaccgtttacccaccgtttaccgttaacccggtttcccgggaaccccggtaacgtaaacgggttaacggtaacgtaaccgtaaaacggtacgtcggtacgtacgtaccg

SEQ ID NO: 303285 - DNA, 576 bp, Homo sapiens
  misc_feature: GZ8MTXP02GDCVA.10.87.H10.1.454.CMB.2.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatcgacccagtctccatcttccgtgtctgcatctgtagganacagagtcacatcacttggtcgggcagtcagcctattagcagctggtagcctggtatcagcagagccgaggggacnccctaagctctgatctatgctgctatccagtttgacaggtacggtcggggtcccgtagtacgggttcaacggcggacgaggtcggatcggtgggactagtatttcgctctacaccatacaacaactgacagcctaggtagtactttagactaaacttactacgtcgtaacgtaacgacggtactacggtacttacccggtttaccaccgttcctaccggtttacccgggaaccccggtaacgtaaacgggtcggtaaacggtaaccgaaaacgtaacgtttccggtaggcctaaccgg

SEQ ID NO: 303286 - DNA, 651 bp, Homo sapiens
  misc_feature: GZ8MTXP02GDIDP.10.87.H10.1.454.CMB.2.raw
  modified_base (285)..(285): a, c, t, g, unknown or other
  misc_feature (285)..(285): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggcttcttttaggaggtgcccagtgtcaagtgcagctgggtggagtcgtgggggaggcgtggtccagccgtgggggtccctgagctctcctgtgcagcctctggattcgacttcgaaatgtcnggcatgcacgtggtccgccaggcctaccaacggaaggggctgggagtgggtgctagttcttnatttgaataagaaaaaggtatattancgcgaccgtccgagaagggccctattcgagcactcctcaacgaacgactacttaccgacggacctacggtagtactcgtacgtaactaaacgtacgaacccgacgtacccgaagaacggtaaacggtaggaacggaaacgtacgggtaccttaaagttacgttaaacgttagttacggtacggtaacgtaaacgggttacccttacccgaacgtaacgtaaaaaccgtaacggtaacggtagggggtacctttaaaggaaccggtacggtaccggggg

SEQ ID NO: 303287 - DNA, 662 bp, Homo sapiens
  misc_feature: GZ8MTXP02I7VM6.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtggtcccgccaggcctccgaaacggaaggggctggaggtgggtggctagtttctttcatttgaagtaagaaaaaagggtattaagttatacgaccgtaccgtccggtaggaaacggggtaccgtattaccgaagtcaacgttacctaccgaagaacgtactatttacccgagtacggtaccgtaacggtagtactacgtacgactaaaacgtcgaaacctacgacccgtaggaagtaacggtaggaacgggaacacgggtactaacgttagtacttagttagtacggaacggtaacggtacccttaccgaacccgtaagtaaaaccgttaaagtaggtacgggggtactttacggaacgtaaccgggg

SEQ ID NO: 303288 - DNA, 695 bp, Homo sapiens
  misc_feature: GZ8MTXP02GE3X1.10.87.H10.1.454.CMB.2.raw
  modified_base (272)..(272): a, c, t, g, unknown or other
  misc_feature (272)..(272): n is a, c, g, or t
  modified_base (405)..(405): a, c, t, g, unknown or other
  misc_feature (405)..(405): n is a, c, g, or t
tcagcatagtagtgcacgaccggtgctcgatttagcagtactgcgttgggtttggggagctctgggagaggagcccagcactagaagtcggcggtgttccattcggtgatcagcagtgaacacaaaggactcaccatggagtttgggctgagcttgggtttcctggtggctcttttaggaggtgcccagtgtcaagtgcagctggtggagtcgtgggggaggcgtggtccagccgtgggggtccctgacgactctcctgtgcagcctctggnttcgacttacgaaatgtctggcagtgcacgtcgggtcccgccgaggcctacccgaaacggaggggctggggaaggtggggtggctaggtttccctttactagtttgaagtaaaggaaaaaaggtattagttanggacgtaccctcgtaggaacgggtcgtactcacgcactactacccgaagacgaactacgtttaccgaacggtacccgtaacgggttcgtaacttaccgttagacctaaaacgtacgaaacccgtacgtacccgtaggaacggaaaggttacggaacgggaaccggaaccggtacgttaaagttacgttaacgttaagttacggtaacggtaccggtaaaacgggtaacccctttaacccgaaaccgttaacgaaaaccgttaagttaacggggtacgggggtttaaccgg

SEQ ID NO: 303289 - DNA, 732 bp, Homo sapiens
  misc_feature: GZ8MTXP02JAAA8.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctcgtggacttcgacttacgaaatgtctggcagtcgctacgtcgggtcccgccgacggcctaccgaaacgggaacggggtcgtggggaggttggggtcggtcgtacgtttcgtttctagtttagagttaaaggaaaaaagggtattaagtttagtacggaccgtacccgttacgggtacggggaaacggggtcccgtaagttaccgagtccgtaactccgtacccagaacgtacttaacgtttacccgaaacggtacccgtaacgggttacgtaacgttccgtacggtaactaaaacgtaccggtaacccaacggtacccgtaagaaaggtaaacggaggaacgggaacgtacgggtactaagtttggtaaccttaggttaggtacgaaacggtaaccggttacccgttaccaacgtaaacgtaaacgttaagtacggttacgggggtactttacgaacgtacgggtacgggg

SEQ ID NO: 303290 - DNA, 641 bp, Homo sapiens
  misc_feature: GZ8MTXP02IRMU8.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtgggtcccgccaggcctccgaacggaaggggctgggagtggggtgctagtttccttctatttgataagaaaaaaggtatagttatgaccgtaccgtccgtagaaacgggccgtaattcagtacagtctacccgagacgtaactactttaccgaagtcccaacggttgtaactccttaggaaccaaaagttcgaaacccagacccgtaggaacggtaaagtaggaacggaaccgaacgggtaccttagtagttaacttaacgttggtaacggtacgaaaccggtaaccctttaccccgaaacttacgaaaaacgttagtaacgggttacggggggtttaacc

SEQ ID NO: 303291 - DNA, 698 bp, Homo sapiens
  misc_feature: GZ8MTXP02JCYZ0.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtgggggtccctgagactctcctgtgcagcctctggattcgacttcgaaatgtctggcatgcacgtcgggtccgccgaggcctaccgaaacggaaggggcgtgggaggtgggtggctagtttctttctagtttagaagtaaggaaaaaagggtattaagttataggaccgtaccgtccgtaggaaacgggtccgtattcgacgactactccgtacccgagaacgtaactaacgtttacccgaacggtacccgtaacgggttacgtactcgtagaacctaaaacgtacgaaccgacgacccgtaggaaacggaaaggtaggaacgggaaccgtaacgggtaccttaagtacgttaacgttagtttaggtacggaccggtaaaccggtacccttaacccgtaacctaaacgtaaaacgttaacggttaaggttacgggggttactttaacggaacgtacggtaccggggg

SEQ ID NO: 303292 - DNA, 574 bp, Homo sapiens
  misc_feature: GZ8MTXP02HQG5R.10.87.H10.1.454.CMB.2.raw
  modified_base (468)..(468): a, c, t, g, unknown or other
  misc_feature (468)..(468): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagctctcctgtgcagcctctggattcgacttcgaaatgtctggcatgcacgtgggtccgccgaggcctccgaaacggaaggggcgtagggacggtggggtaggctagtttcctttctagtttgagtaaggaaaaaagggtaatattaagtgaccgtacccgtcgtaggaacgggccgtattcgagcatctccagtacgactacttccgagtcctacggtntactcgtgacaaagtcgaccagcctagagagtgagacgacggctagtcgtacttagtgtcgacgacgtaacctaccgactacgaaactagtacggtaggggttacg

SEQ ID NO: 303293 - DNA, 650 bp, Homo sapiens
  misc_feature: GZ8MTXP02GU03B.10.87.H10.1.454.CMB.2.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttcgtgtctgcatctgtagganacagatcaccatcacttgtcgggcagtcagcctattagcagctggttacgccgtggtatcagcaggaaggccgagggggacnccccgtaagctcctgatctatgctgcatccagtttgactaggtacggtcggggtaccctagacggggttcaggtccggacgaggtggatcgtagggtacaggtacttcggcttcctacaacctactaccaaaccaacccgttggacctaggtcccgtaggtacggttagttttacgaccttaaaacctttactacttacggtaaccaaacgtacggtacctacggtaccttacccggttttacccacccgtttaccgttaacccggttttaccccgggggaacccccggggtaactaaaaccgggggttaacgggtaaaccgggttaaaccaaaaccggggttacgtacgggtacggtaccgtaaccg

SEQ ID NO: 303294 - DNA, 630 bp, Homo sapiens
  misc_feature: GZ8MTXP02JK730.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtggggggtccctgagactctcctgtgcagcctctggattcgacttcgaaatgtctggcatgcacgtgggtccgccaggctccgaacggaaggggctgggaggtggggtggcgagttccttcatttgaataggaaaaaggtatattatgacgacctcgtagaacgggccattcagcagtctcccgagacgactacgtttaccgaacggccctaacgggtcgtagttacgtacggtaacctaaaagttacgaaacccgaacggacccgttaggaacgaaggtaggaacggaaccgtacggtactagtacgttacttagttcgtacggaccgtaaacggtaacccttaccgaaccgtaacgaaaaccgttaagtaacgggtacgggggtttaaccg

SEQ ID NO: 303295 - DNA, 604 bp, Homo sapiens
  misc_feature: GZ8MTXP02HL80I.10.87.H10.1.454.CMB.2.raw
  modified_base (306)..(306): a, c, t, g, unknown or other
  misc_feature (306)..(306): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagcttgggttttcctggtggctcttttaggaggtgcccagtgtcaagtgcagctggtggagtcgtgggggaggcgtggtccaggccgtggggggtccctgagactctcctgtgccagcctctggattcgacttcgaaatgtctggcatgcactgggtcccnccaggcctaccgaaacggaaggggctgggagtggggtggctagttcttcatttgataagaaaaaggattattatgcgcctccgtagaagggccgattcagcatctaccgagacgactactttaccgaacggtccacggtgtatcgttagacctaaagtcgaaccacgcctagagaagtaggacggacacggtctaagtcgtacttagttggacgtacggtaaaccggtacccttaccgtaaccgtacgtaaaaccgtaagtaggtacgggggtatttacggaacgtacggtacggggg

SEQ ID NO: 303296 - DNA, 772 bp, Homo sapiens
  misc_feature: GZ8MTXP02IS8TQ.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaatgtctggcatgcactgggtccgccaggcctccgaacggaaggggctgggaggttggggtggctaggtttctttcgtagtttagataaggaaaaaaagggtattaagtttaatcggacccgtacccgttaccgggttaggaaacgggggtcccgtaagtttaccgaggtaccctaagtccttacccgaaggaacgaaccttaacgttttacccgaaacggggtaccccgtaacgggttgttaaacgtcgttaggaacctaaaacgttccggtaaccgaacggtacccgttaggaaacggtaaacggtaggggaaacggaaaccggtaccgggacctttaagtacggtttaaaccgttaaggtttggtacgtaacccggggaaacggttacccctttacccgaaacccgttaacggtaaaaacccgtttaaaggttacgggtttaacggggggtaccctttttaaagggaaacccgtaacgggtttaacccgggggg

SEQ ID NO: 303297 - DNA, 580 bp, Homo sapiens
  misc_feature: GZ8MTXP02J2G67.10.87.H10.1.454.CMB.2.raw
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcggcagtcagcctattagcagctggttacgcctggtatcagcagagccgagggggacnccccgtaagctcctgatctatgctgcatccagttgcaggnggtcgggtcccgtgagggttcaggcgcagtgatcgtgggacagtactttcgctctcacctataccaacacctgacacgtccgtaggaggttactttacggaccttaaactttaccgttaactacggttaccaaacggacgggtacttaacgtccgttaaccggtttaccccaccgttaccgttaaccgtttcccggggacccccgggtaaacctaaaagggtcggaaacggtacgaaaacgtaacgtcggtacggactcgg

SEQ ID NO: 303298 - DNA, 589 bp, Homo sapiens
  misc_feature: GZ8MTXP02H9141.10.87.H10.1.454.CMB.2.raw
  modified_base (439)..(439): a, c, t, g, unknown or other
  misc_feature (439)..(439): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtcgggtcccgccagggcctccgaaacggaaggggctgggaggtggggtggctagtttctttcatttgaatagaaaaaggtatattatgcgcctcgtggaacgggccgattcagcatctccagagacatttaccaaggcctagggtntatctagacaaatcgaccagcctagagaacgtggaaggacgacggtactagtacgttactagttgtcggacgtaaacggtcccttacccgaacgtacgaaaacgttaacgtacggttcgggggtactttaacggaacgtacggtcggggg

SEQ ID NO: 303299 - DNA, 660 bp, Homo sapiens
  misc_feature: GZ8MTXP02IVOGR.10.87.H10.1.454.CMB.2.raw
  modified_base (476)..(476): a, c, t, g, unknown or other
  misc_feature (476)..(476): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgccacgtcgggtccgccagggcctccgaaacggaaggggctgggagtgggtggctagtttctttcagtttagaagttaaggaaaaaaagggtattaattagacgtccgtaccgtccgtaggaaacggggtccgtaattcgaagcctaagtcctacagaagacctaagtttaccgaaggtcctacggtntactctagactaaagtcgacagccgtagaagtaagtaggacggtacgacggtactagtacgttaaacgtatttacggacggtaccggtaaacgggttacccctttaacccgaaccgttacggtaaaaaccgttaagttacgggtacggggggtacctttaaggaaaccgtaccggtaagggggg

SEQ ID NO: 303300 - DNA, 518 bp, Homo sapiens
  misc_feature: GZ8MTXP02FF8LS.10.87.H10.1.454.CMB.2.raw
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcagtcagcctattagcagctggttagcctggtatcagcaagagccgagggggacnccccgtaagctcctgatctatgctgcatccagtttgcagngtcggggtccgtcgagtcagcgcgagtggatctggggacagtattcgcttctcaccataccaacacctgcagctgaggtatttgactaaccttactactagtacaacgaggctagctacgtttcccacttccgacgtttaccggaccccggaactaaacggtcggaacggtacaaaacgtacgttacggcgtcgtacg

SEQ ID NO: 303301 - DNA, 549 bp, Homo sapiens
  misc_feature: GZ8MTXP02F6GWH.10.87.H10.1.454.CMB.2.raw
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
  modified_base (485)..(485): a, c, t, g, unknown or other
  misc_feature (485)..(485): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccaggccgtgggggtccctgagactctcctgtgcagcctctggattcgacttcgaaatgtctggcatgcacgtgggtccgccaggctaccgaaggaaggggctgggaggtgggtggctagttcttnatttgatagtaaaaagggatattangaccgtccgtaccgtaggaacgggccgattcgagcatctccagagacacgttaccaaggcacggtntactctagacaatcacagcctgagagtgagacacgactatgtactntgtacgcgaacgaccttaccactagaaactaagtacgtgggggtacttagacgtacgtacgggg

SEQ ID NO: 303302 - DNA, 707 bp, Homo sapiens
  misc_feature: GZ8MTXP02FMOO1.10.87.H10.1.454.CMB.2.raw
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagatcaccatcacttggtcggcgagtcagcctatagcagtctggttacgccgtggtatcgagacaaggaagccggagggggacaccccgtaagcctcctgactctatcgctcgctacttccgtagtttcgcgtaaggtcgggttccggggtaccccttacggtacgggttcgagggtccggacgtaggtggacgttcggtaacggggtacttaaaggttcgtttcgtccttacctaccaaccctaactacccaaaacctacccgtgaccgtaacgtccgttaggtaggtttacttttaccgaactttaaacccttaacgttaccgtacgtaactaaaccggtacggtaccgttaaacggtacctttacccggtttacccctaacgtttaccccggttaacccggtttaacccccgggggaacccccgggtaaaagtaaaaccggtaacgggggtaaaaccgtaaccggtaaaaaccgtcggtttacgggtacggtccttaacgg

SEQ ID NO: 303303 - DNA, 757 bp, Homo sapiens
  misc_feature: GZ8MTXP02GO6ZI.10.87.H10.1.454.CMB.2.raw
  modified_base (268)..(268): a, c, t, g, unknown or other
  misc_feature (268)..(268): n is a, c, g, or t
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggtttcctggtggctcttttaggaggtgcccagtgtcaagtgcagctggtggagtcgtgggggaggcgtggtccaggccgtgggggtccctgagactctcctgtgcagcctntggattcgacttcgaaatgtctggcatgcacgtcgggtccgccgaggcctccgaaacggaaggggctgggaggtggggtggctagttccttctatttagaagtaagaaaaaagggtatattatgtagacctccgtagaacgggcgattcgagcactctacccgagaacgtactaacgtttaccgaaacggcccgtaaacgggttacgtaagttaccttgggaaaccctaaaagttaccgaaaccccgtaacggtaaccccgttagggtaaaacggaaacgggttaggggaaaacgggggaaacccgtaacggggtaaacccgtttaaaggttaaaccggtttaacgttaaacgggtttttaggaaccggggtacccgggtaaaaaccgggggttaaccccctttaaaccccgtaaaccccggtttaaaaccggtaaaaacgtttaaaaacggttttaacgggggtaacgggggggtttttaaaccccgg

SEQ ID NO: 303304 - DNA, 652 bp, Homo sapiens
  misc_feature: GZ8MTXP02HFG98.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagcttgggttttcctggtggctcttttaggaggtgcccagtgtcaagtgcagctggtggagtcgtgggggaggcgtggtccaggccgtgggggtccctgagactctcctgtgcagcctctggattcgacttcgaaatgtctggcatgcacgtcgggtccgccaggcctaccgaacggaaggggcctagggaggtggggtggctagtttctttcagtttgaataaggaaaaaaggtataattagtgaccgccgtccgtaggaacgggtccgagttcaggcaactccgtacccaagacgtaactacgtttaccgaaacggccgtaacggtacgtactcgttacgacgtaaatcgtaaccagtcccgtagtaaggaaggtaggaacggacgaacggtacttagtacgttaactagttcggtacgtacggaaacgtacccgttaccgaacccgtaagtaaaccgttaacgtaaggtcgggggttactttacggaacgtacggtaaccggggg

SEQ ID NO: 303305 - DNA, 558 bp, Homo sapiens
  misc_feature: GZ8MTXP02I3GDI.10.87.H10.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctcatcttccgtgtctgcatctgtaggagacagagtcacatcacttgtcgggnagtcagcctattagcagctggttagcctggtatcagcagaagccagggggacnccctaagctcctgatctatgctgcatccagtttcgcaggaggtcggggtcccgtcgagggttcaggcggcagtggatcgtagggacagtatttcgcttcgtcaccataccaaacaactgacacgtcgtaggtagtacttttgaccttaaaccttactactggttaacaacgtagctacgtcctacgtttacccacgttaccgtacgtttcccgggaccccgggtaacgtaaaacgtcggggaaacggttacgaaaaaccgtacggtcggtacgtcgtaccg

SEQ ID NO: 303306 - DNA, 763 bp, Homo sapiens
  misc_feature: GZ8MTXP02F532U.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgacgactctcctgtgcacgcctcgtgattcgtacttacgaaatgtctggcatgcacgtcgggtccgccgaggcctaccgaaacggaaggggcgtggggacggtggggtggcgtaggtttcctttactagtttagaagttaaaggaaaaaaaggggttaattagttaagtacggaccgtacccgttaccggtagggaaacggggtcccgtaagttccgacgtctacgtcctacccgaagacgtaacctacgtttacccgaaacggtacccgtaacgggttacgtaacttacgtacggaacctaaaacgttacgaaaccccgtacggtacccgttagggaaacggttaagggaacgggtaaacgggaaccgtaaccggggtacctttaaagtaccggtttaaagtttacgtttacggtacggaacccggttaaaaccgggttaacccctttaacccgaaaccgttaaaacggttaaaaccgttaaagggtttaacggggtacgggggttttaaacccg

SEQ ID NO: 303307 - DNA, 554 bp, Homo sapiens
  misc_feature: GZ8MTXP02JXOIB.10.87.H10.1.454.CMB.2.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaagganacagagtcaccatcacttggcgggcgagtcagcctattagcagctggtagcctggtatcagcaagagccgaggggaccnccctaagcctcctagactctagtgctgctactccgtagtttgcgaggacggtcggggtaccctcgacgggttcacggcggacnggtggagtcgtggggactagtacttcgacgtcctacaccataccgaacaccgtcgacacgtcagtagttattcgactaacttactactcgtacaacgcgtctacgtctaccgttccacgtcctaccggtttccggaaccccggaactaaacggtcggtaacgtacgaaaacggtcgtcggacgtctaccg

SEQ ID NO: 303308 - DNA, 620 bp, Homo sapiens
  misc_feature: GZ8MTXP02GZ5H9.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctgggtggagtcgtgggggaggcgtggtccagccgtggggggtccctggagactctcctgtgcagcctctggattcgacttcgaaatgtctggcatgcactcggggtcccgccaggcctaccgaaacgggaaggggcgtgggaggtggggtggctagtttctttctagttttgaagttaaggaaaaaaagggtaattaagtttaagtcgaccgtacccgtccggtaggaaacgggcccgtattcagcactctaccagacgactactttaccaacggcccaacggtgtactctacgacaaatcgaaccagacctagaagaagtggaaggacgacggactatcgtactagttagtgacgtaacgacccttaccactacgaaaacgttaagtaggtacgggggactttacgaacgtacggtaccgggg

SEQ ID NO: 303309 - DNA, 756 bp, Homo sapiens
  misc_feature: GZ8MTXP02FLMN7.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtgggtccgccagggcctaccgaacggaaggggctgggaggtggggtggctagtttctttctagtttgaagtaaggaaaaaagggtattagttatcggacgtacccgtccggtacggaaacggggccgtaattcgagtacctactctacccgtaagacgaactaactttacccgaaacggcccgtaacggttcgtacttaccgttacggaactaaaacgttcgggaacccaacggtacccttaagggaaacgtaaagggttacgggaacggggaaccgaaccggggtactttaaacgttacggttaaaaccgtttaagtttcgggttaacggtaaaccgggtaaaaccgggttaccccctttaaaccgtaaccccgtttaaaaggtaaaaacccgtttaaaggtttaacggggttacggggggttaccttttaaacggaaaccggttaacggtacccgggggg

SEQ ID NO: 303310 - DNA, 644 bp, Homo sapiens
  misc_feature: GZ8MTXP02F259V.10.87.H10.1.454.CMB.2.raw
  modified_base (464)..(464): a, c, t, g, unknown or other
  misc_feature (464)..(464): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtgggtcccgccaggcctaccgaacggaaggggctgggaggtggggtggctagtttcttcatttgaagttaagaaaaaagggtattaagttatcgaccgtaccgtccggtaggaaacggggccctattcagctatcctaccagacgactacgtttaccgaacggccacggtntatccgtagaacctaaagtcgaacctagacccgtagaaacggaaggtacggaacggaacgacggtactaagtacgtaacttagttaggtacggacggtaaacggtaccctttacccgaaccttaacgtaaaacgttaagtacggtacgggggtactttacggaaacgtacggtacggggg

SEQ ID NO: 303311 - DNA, 589 bp, Homo sapiens
  misc_feature: GZ8MTXP02GDEHI.10.87.H10.1.454.CMB.2.raw
  modified_base (282)..(282): a, c, t, g, unknown or other
  misc_feature (282)..(282): n is a, c, g, or t
  modified_base (397)..(397): a, c, t, g, unknown or other
  misc_feature (397)..(397): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacgttggtcgggcgagtcagcctatagcagctggttagcctggtatcagcagaacgccgaggggacncccctaagcctctgatctatgtctgctatcctagtttcgcgaggtacgggtcgggtccccgtagtacgggttcaggccggacgtagtggatcgtagggactagtactttcgctcncaccataccaacacgtgactacgccgtagtaggttactttacggactaaacctttacgtactacgtaacaacgtacgggtactacggtacttaccgtttcccaacgtttacccgtccggtttaacccgggccccggtaaacgtaaacggtcgggaaacgtaacgaaaccggtacgttaggcggtactaccgg

SEQ ID NO: 303312 - DNA, 631 bp, Homo sapiens
  misc_feature: GZ8MTXP02JZ5IY.10.87.H10.1.454.CMB.2.raw
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagcttgggttttcctggtggctcttttaggaggtgcccagtgtcaagtgcagctggtggagtcgtgggggaggcgtggtccaggccgtgggggtccctgagactctcctgtgcagcctctggattcggacttcgaaatgtctggcatgcactcgggtccgccaggcctaccgaacggaaggggctgggaggtgggtggctagttctttcatttgaagtaagaaaaaagggtataagttatcgacgtacccgtccggtaggaacgggcctattcagcatcctaccaagagtacacgtttaccgaaacggcccgtaacggtgtactcgtagacctaaagtcgaaccagtacccgtagaagtaaggtagaaggtacgacggtactagtacgttactagtgtacgtacgaacggtacctacccgtaaccgtaacgtaaacgtaaggttaacggtacgggggtactttacggaaaccgtacggtaccggggg

SEQ ID NO: 303313 - DNA, 575 bp, Homo sapiens
  misc_feature: GZ8MTXP02JQGV9.10.87.H10.1.454.CMB.2.raw
  modified_base (373)..(373): a, c, t, g, unknown or other
  misc_feature (373)..(373): n is a, c, g, or t
tcagcatagtagtgcacgaccggtgctcgatttagcagtactgcgttgggtttggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcacgtgggtccgccaggcctccgaacggaaggggctgggagtggggtggctagttctttcatttgaatagaaaaaggtatattangcgcctcgagacgggccgatcagcatctaccagacgactactttaccgaaggccgtacggtgtactcttagacaaatcgaccagccgtagaacgaagtaggaacggacgacggtactagtagtactagttgacgtacgaacggtacctaccacctagaaaccgtagtacggtcgggggtactttacggaacgacgtacgggg

SEQ ID NO: 303314 - DNA, 532 bp, Homo sapiens
  misc_feature: GZ8MTXP02GPRUI.10.87.H10.1.454.CMB.2.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
tcagcatagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtagganacagagtcaccatcacttggcgggcagtcagcctattagcagctgtagctggtatcagcagagccaggggacnccctaagctcctgatctatgctgcatcctagtttgcaggaggtcggggtccctagagggttcaggcggtacgagtggatcgtgggacagtattcgctcgcaccatacaacaccgtnacacgcctgagtatttagctaacttacatntacaacgagctagtactacgtttacccacttcctacgtttcccgggaccccggtaacgaaacgggtaacggtaacggtaaccaaaacggtacgtacggttacgacgttaacg

SEQ ID NO: 303315 - DNA, 577 bp, Homo sapiens
  misc_feature: GZ8MTXP02JTF7C.10.87.H10.1.454.CMB.2.raw
  modified_base (498)..(498): a, c, t, g, unknown or other
  misc_feature (498)..(498): n is a, c, g, or t
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtggggggtccctgagactctcctgtgcagcctctggattcgacttcgaaatgtctggcatgcacgtcgggtccgccaggcctaccgaacggaaggggctgggaggtggggtggctagttctttctatttgaataaggaaaaagggtatattagtgcgaccgtcggagaacgggtccattcagctactctaccagacgactattaccgaacgtccgacggtgtactctagacaaatcgacctagccgtagacgaaggtgaagcgacggntatgtactagtgcgacgacgtaccctacacgtagaaacgtaagtacgggtaggggtactttacgaacgtacgtacgggg

SEQ ID NO: 303316 - DNA, 794 bp, Homo sapiens
  misc_feature: GZ8MTXP02JG07I.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaatgtctggcatgcacgtcggggtccgccgagggcctacccgaacggaaggggcctggggaggtgggtggctagtttctttcagtttagaagtaaggaaaaaagggtattaaagtttagtagtaccgtacccgttaccgggtacgggaaacgggggtcccgtaagtttaccgaacggtcctaacgttacccgttacccgaaaggtaacgtaacccgttaaccgtttttaaccccgaaacggggtacccccgtaaacgggggttacgtttaaccgttaccggtttaacgaaacccgtaaaaggttacccggaaaccccgtaaccgggtaccccggtaaggtaaaacggtaaacgggttacggggaaacgggtaacggaaaccgggttacgttaaacgttacggttaaccgtttaagttacgggtacggtaaccgtaaccgggtacccttaccgaaccttaagtaaaccgttaaagtacggttacgggggtactttaacggaacgtacggtaaccggggg

SEQ ID NO: 303317 - DNA, 664 bp, Homo sapiens
  misc_feature: GZ8MTXP02F67AT.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccaggccgtgggggtccctgagtctctcctgtgcagcctcgtggacttcgacttacgaatgtctggcatgctacgtcggtccgccaggcctaccgaacggaggggctgggagtggggtgctacgtttcttctagtttgaagtaaaggaaaaaagggtattaattagtacgtaccgtccgtaccggtagggaaacggggtccctagttacaggctaactcctaccgacgacgtacttacgtttaccgaacggtccgacgggttatacgtcttagactaaacgtcgaacctaggctacggaagtaacggtaggacggaacgtacggactagtacgtaacgttagttaggtacgtacggtaaccggtaccccttaccgtaaccgttaacgtaaaaccgttaagtacgggtacgggggtacttacggaaccgtacgggtacgggg

SEQ ID NO: 303318 - DNA, 717 bp, Homo sapiens
  misc_feature: GZ8MTXP02GKXN5.10.87.H10.1.454.CMB.2.raw
tcagcatagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggagcgtggtccagccgtgggggtcctgagactctcctgtgcagcctcgtggtattcgactacgaatgtctggcatgcacgtcggtccgcgacggctaccgaacgggaacggggcgtggggtaggtggggtcggtcgtagtttcctttcgtagtttacgaacgtaaaaggaaaaacgggtattagttagtcgacgtaccgtcggtaggaacgggccgtattaccgagctaatcctacgagtacgtactacgttaccgaacggacccgtaggttagtactacgtacgtactaaacgtcgtaaaccgcggtaccgtaaggaaacggtaaaggtcggaaacggggtaaccgtaacggtaccgttaagttaacgttaaccgttagtttacggtacggtaaacccggtaaaccgttaacccgttaccgaaaccgtttaacgaaaaacgttacgggttacggggttacgggggtacctttaacgggaaacccggtacgggtaacccggggg

SEQ ID NO: 303319 - DNA, 769 bp, Homo sapiens
  misc_feature: GZ8MTXP02FIAW5.10.87.H10.1.454.CMB.2.raw
tcagcatagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcggtggtccaggcccgtggggggtccctgagctctcctgtgcagcctctggattcgacttacgaaatgtctggcatgcacgtcgggtcccgccaggctaccgaacggaaggggctgggtacggtggggtcggctaggtttcctttacgtatttagaagttaaaggaaaaaaacgggtattagtttagacggaccgtaacccgtccggttaggaaacggggtccgtacgtttcgaacggctaactcttacccgaacggacgtaactaacgttttaccccgaaacgggtaccccgtaaacgggttcgttaaacgttacgtacggtaaccctaaaaacgttacggaaccccctaacgaccccgttaggaaacggaaacgggtaggaaaccggggttaaccgaaaccggggtaccttaacgttaggttaaaccgtttaaacgtttgggttaaccgacccgggtaaaacggttaacccccgttacccgtaaacccgttaacggtaaaaaacccgttaaacggtttaacgggttacgggggggttttaaaccg

SEQ ID NO: 303320 - DNA, 517 bp, Homo sapiens
  misc_feature: GZ8MTXP01A390E.25.22.B11.1.454.CMB.2.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (452)..(452): a, c, t, g, unknown or other
  misc_feature (452)..(452): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggccccaaatcatcatttatgatgtcagtcatcggccctctggatttcnggtcgcttcctctggctccaagtctggcaactcggcctccctgaccatctcgggactccaggctgaggaccgaggctacttattatgtctattctatacagagacacaacaacgtctggtgtcggtcggngggaacgaacgttgtacgttcgtcgtcgcgccgacgcgcgcccgtccgtcgctcgttcgttcccc

SEQ ID NO: 303321 - DNA, 514 bp, Homo sapiens
  misc_feature: GZ8MTXP01DOGQ0.25.22.B11.1.454.CMB.2.raw
  modified_base (489)..(489): a, c, t, g, unknown or other
  misc_feature (489)..(489): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtgcttataactatgtctcctggtcccaacaacacccaggcaaggcccccaaactcatcatttatgatgtcagtcatcggccctctggagtttctaatcgctttcctctggctccaagtctggcagcacggcctccctgacaatctctgggctccgaggctaggaggacgaggctagattattactggctactcatatgacacatcactaaatcccgtcttcggacttgggaccagggtcaccgttcgttgggttcngcccaaggcccacccatcgctaacc

SEQ ID NO: 303322 - DNA, 511 bp, Homo sapiens
  misc_feature: GZ8MTXP01ANTK0.25.22.B11.1.454.CMB.2.raw
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (444)..(444): a, c, t, g, unknown or other
  misc_feature (444)..(444): n is a, c, g, or t
tcagactgtacagtcacgaccggtgctcgatttagacgacagctcaggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggccccaaactcatcatttangatgtcagtcatcggccctctggagtttcnggtcgcttcctctggctccaagtctggcaactcggctccctgaccatctcgggctccaggctgagacgaggctactattatgctatttcatacagagacacaacagtctggtgttcggcgngggaaccaaggttgaccgttctcgggtcacgcccagggctcgcccctggtccactcttcgttccccg

SEQ ID NO: 303323 - DNA, 541 bp, Homo sapiens
  misc_feature: GZ8MTXP01C2FKZ.25.22.B11.1.454.CMB.2.raw
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (448)..(448): a, c, t, g, unknown or other
  misc_feature (448)..(448): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtgcttaataactatgtctcctggtcccaacaacacccaggcaaggccccaaatcatcatttangatgtcagtcatcggcccttntggagtttctggtcgctttcctctgctccaagtctggcaactcggcctccctgaccatccgtcggggctccgaggcctggacggacgaggtctaacgttattattgctatttcatacagagacaccaaacngtactggtgttcggcggtagggaaccaaggttcgaccgttcgtcggtcacgcccaaggcctcgcccccgtggtccacttccgttcgttccccg

SEQ ID NO: 303324 - DNA, 537 bp, Homo sapiens
  misc_feature: GZ8MTXP01BFFF9.25.22.B11.1.454.CMB.2.raw
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (447)..(447): a, c, t, g, unknown or other
  misc_feature (447)..(447): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgacattggtncttaataactatgtctcctggtcccaacaacacccaggcaacggcccccaaatcatcatttangatgtcagtcatcggccctntggtagtttctggtcgctttcctctggctcagtctggcaactcggcctccctgaccatcgtcggggctccaggctgaggacgaggtcttacttattacttgctatttcgaattacagacgaacacccaagngtacgtggtagttcgggcggagggaacctaaggttcgaacccgttcgtcggtcacgcccaggctcgcccctcggtcactcttcgttcccc

SEQ ID NO: 303325 - DNA, 515 bp, Homo sapiens
  misc_feature: GZ8MTXP01C4VM2.25.22.B11.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttangatgtcagtcatcggccctntggtatttcnggtcgcttcctctggctccaagtctggcaactcggcctccctgaccatctcggggctccaggctgaggacgaggctacttattatgctatttcatacaganacaccaacagtctggtgttcggcgaggaacctaagttcgaccgttcgtcggcagcccaaggctcgcccctggtcacgtcttcgttcccc

SEQ ID NO: 303326 - DNA, 560 bp, Homo sapiens
  misc_feature: GZ8MTXP01CI6IY.25.22.B11.1.454.CMB.2.raw
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (460)..(460): a, c, t, g, unknown or other
  misc_feature (460)..(460): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtnctttaataactatcgtctcctggtacccaaacaacacccaggcaacggacccccaaactcatcatttangatgtcagtcatcggccctntggtatttcnggtcgcttcctctggcctcaagtctggccaacgtccggcctccctgaccatcgtcggggctccgaggctggagacgagtcttaacttattattgctatttacgattaacagacaacaacccaanagtcgtggtggttcggagggtaggaacctaagttcgaaccgttccgtcggcacgcccgagggcctcccgccccgtcggtccttactccgttccgtccccc

SEQ ID NO: 303327 - DNA, 543 bp, Homo sapiens
  misc_feature: GZ8MTXP01DJL9C.25.22.B11.1.454.CMB.2.raw
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttataaactatgtctcctggtcccaacaacacccaggcaaggcccccaaatcatcatttatgatgtcagtcatcggccctctggtagtttctggtcgctttcctctggctccaagtctggcaactccggcctccctgacctagtcgtcggggctccgaggcctggaggacgaggtcttacgttattattgctaatttcaattacagtaacgacaccaanagtctggtgttcggcggnggaactaaggttgaccgttcgtcgtcacgccaagggctcgccccctggtcacttccgttcgttccccg

SEQ ID NO: 303328 - DNA, 526 bp, Homo sapiens
  misc_feature: GZ8MTXP01DSEZX.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtncttataactntgtctcctggtcccaacaacnccaggcaaggccccaaatcatcatttangatgtcagtcatcggccctntggagtttctggtcgctttcctctaggctcaagtctggcaactccggcctccctgaccatctcggggctccaggctgaggacgaggtctacgttattattgtactatttcaattacaagacgacaccaacagtcgtggtgttcggcggaggaacaagttgaccgttcgtcgtcacgccaacggctacgccctcggtcactcttcgttcccc

SEQ ID NO: 303329 - DNA, 543 bp, Homo sapiens
  misc_feature: GZ8MTXP01CYXB4.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (441)..(441): a, c, t, g, unknown or other
  misc_feature (441)..(441): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttataactatgtctcctggtcccaacaacaccaggcaagccccaaatcatcatttatgatgtcagtcatcggccctctggtagtttctggtcgctttcctctggctccaagtctggcaactcggcctcctgaccatctcggggctccgaggctgaggacgtagcttaacttattattgactatttcaattacagagacaccaanagttactggtgttcgggcgagggaaccaaagtttcgaccgttcgttcggcaacgttcccaaggtccttacgcccccttgggtccacttcgttcgttcccccg

SEQ ID NO: 303330 - DNA, 527 bp, Homo sapiens
  misc_feature: GZ8MTXP01EOO77.25.22.B11.1.454.CMB.2.raw
  modified_base (314)..(314): a, c, t, g, unknown or other
  misc_feature (314)..(314): n is a, c, g, or t
  modified_base (439)..(439): a, c, t, g, unknown or other
  misc_feature (439)..(439): n is a, c, g, or t
  modified_base (511)..(511): a, c, t, g, unknown or other
  misc_feature (511)..(511): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttatgatgtcagtcatcggccctntggagtttctggtcgctttcctctggctccaagtctggcaactcggcctccctgaccatctcggggctccaggctgaggacgaggctacttattacttgctatttcaattacagagacaccaacngtactggtgttcggcggagggaaccaaggttcgacgttcgtcggtcacgcccaaggcctcgcccctcggtcnccgtcttcgttccccg

SEQ ID NO: 303331 - DNA, 520 bp, Homo sapiens
  misc_feature: GZ8MTXP01CT4ZW.25.22.B11.1.454.CMB.2.raw
  modified_base (244)..(244): a, c, t, g, unknown or other
  misc_feature (244)..(244): n is a, c, g, or t
  modified_base (433)..(433): a, c, t, g, unknown or other
  misc_feature (433)..(433): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactntgtctcctggtcccaacaacacccaggcaaggcccccaaactcatcatttatgatgtcagtcatcggccctctggtagtttctggtcgcttcctctggctccaagtctggcaactcggcctccctgaccatccgtcgggctccgaggctggaggacgaggtctacttattattgctatttcatacaganacacacagtctgtgtcggcggaggccaagttgaccgttcgtacggtcagcccaaggcctcggcccctcggtcacttcttcgttcccc

SEQ ID NO: 303332 - DNA, 562 bp, Homo sapiens
  misc_feature: GZ8MTXP01CDDI1.25.22.B11.1.454.CMB.2.raw
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (466)..(466): a, c, t, g, unknown or other
  misc_feature (466)..(466): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacatttgggntcttaataactatgtctcctggtcccaacaacacccaggcaaggcccccaaatcatcatttangatgtcagtcatcggcccctntggtatttctggtcgtctttccctctggcctccaagttcctgggccaaaccgtccgggcccttccctggaccctatccgtcgggggctccgaggctggaggacgaggtctaacttatattgctatttcattacagagacacaacngtactggtcgttcggcggagggaaccaaggttcgacccgttcgtcggtcacgcccaagggcctcgccccgtcggtccacgtccgttcgttcccccg

SEQ ID NO: 303333 - DNA, 520 bp, Homo sapiens
  misc_feature: GZ8MTXP01C5TAN.25.22.B11.1.454.CMB.2.raw
  modified_base (235)..(235): a, c, t, g, unknown or other
  misc_feature (235)..(235): n is a, c, g, or t
  modified_base (321)..(321): a, c, t, g, unknown or other
  misc_feature (321)..(321): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctctggtcccaacaacaccaggcaagccccaaatcatcatttatgatgtcagtcatcggccctctggatttcnggtcgtcttcctctggctccaagtctggcaaactcggccttccctgaccatcctcggggctccgaggctggaggacgaggctacttattatgctatttcattacanagacacaacagtactgtgtggtcggngggaacgaacgttgtacgttccgtcgtcacgccacgaacncgcccgtccgtcnctcgttcgttcccc

SEQ ID NO: 303334 - DNA, 563 bp, Homo sapiens
  misc_feature: GZ8MTXP01B74QN.25.22.B11.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttanaactatgtctctggtcccaacacaccaggcaaggccccaaatcatcatttangatgtcagtcatcggccctntggatttcnggtcncttccnctgctcaagtctggcactcggcctccgtgacctagtcgtcggggtctccgaggtctcggaggtacgtaggtcttacgttattacttcggactacgtttcaattaccgagacgtaacacctaagacgttctcggtgttacggacggtaggaaccctaagtttcgaaccgttcgtcggtacacggttcccaagggtcctacgcccccgtggtaccacgttcgttcgttaacccc

SEQ ID NO: 303335 - DNA, 538 bp, Homo sapiens
  misc_feature: GZ8MTXP01AQ503.25.22.B11.1.454.CMB.2.raw
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggccaccatctcctgcactggaaccagccgtgacattggtnctttataactatgtctcctggtcccaacaacacccaggcaaggcccccaaatcatcatttatgatgtcagtcatcggccctntggatttctggtcgctttcctctggctccaagtctggcaactcgggccctccctgacccatcctcggggctccgaggcctgaggacgaggcttacgttattattgctatttcgattacagtagacaccaacagtcctgggtgttcggcggagggaacctaaggttcgacccgttcgtcgggtcacgcccaaggcctcgcccctggcaccgtcttcgttcccc

SEQ ID NO: 303336 - DNA, 516 bp, Homo sapiens
  misc_feature: GZ8MTXP01AIICT.25.22.B11.1.454.CMB.2.raw
  modified_base (234)..(234): a, c, t, g, unknown or other
  misc_feature (234)..(234): n is a, c, g, or t
  modified_base (450)..(450): a, c, t, g, unknown or other
  misc_feature (450)..(450): n is a, c, g, or t
  modified_base (501)..(501): a, c, t, g, unknown or other
  misc_feature (501)..(501): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctcctggtcccaacaacacccaggcaaggcccccaaactcatcatttatgatgtcagtcatcggccctctggagtttctggtcgcttctctggctccaagtctggcaactcggcctcctgaccatctcgggctccagctgaggacgaggctacttattatgctatttcatacagagacaccaacagtctggtgttcggcggnggaaccaagttgaccgttctcgggtcagccaaggcctcgccccctgggtcnctcgttcgttccccc

SEQ ID NO: 303337 - DNA, 627 bp, Homo sapiens
  misc_feature: GZ8MTXP01C2S36.25.22.B11.1.454.CMB.2.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagtttgggtntactttaataactntcgtcctccgtcgtacccaacaaccaccacgaccaaccgaccccaaactcatactaatttatagtatgtactacgtacacgtccggtcccttcgtacggttagtttactaacttctcttcctcgtcgtcctactaacgtcgtcggcacgccgaccgtccctaccgtacgaactaacttccgtcgtcggacctccgacggcgtaggacgggacgtacggacgtagtaattaattacgtacgtactactactaatagtacgaacaactaactactaacctaaacctacccgtccgtaacggtacgttacggtacgacggtacgtaccgttccgttcggttacgaacgaccgaaccgacccacccacctcgttctc

SEQ ID NO: 303338 - DNA, 522 bp, Homo sapiens
  misc_feature: GZ8MTXP01EYFDO.25.22.B11.1.454.CMB.2.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctcctggtcccaacaacacccaggcaacggccccaaactcatcatttangatgtcagtcatcggccctctggtagtttctggtcgcttcctctgctcagtctggcactcggcctccctgaccatctcggggctcgaggctgaggacgagtctacttatatgctatttcatacaganacacaacagtctggtgtcggcggagggaacctaaaggttcgaccgttccgtcggtcacgcccaggctcgccccgtcggtcactcgttcgttccccg

SEQ ID NO: 303339 - DNA, 542 bp, Homo sapiens
  misc_feature: GZ8MTXP01DW0N0.25.22.B11.1.454.CMB.2.raw
  modified_base (219)..(219): a, c, t, g, unknown or other
  misc_feature (219)..(219): n is a, c, g, or t
  modified_base (448)..(448): a, c, t, g, unknown or other
  misc_feature (448)..(448): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacagtttggtgctttaataactatgtctcctggtcccaaacaacacccaggcaacggcccccaaactcatcatttatgatgtcagtcatcggccctctggtatttctggtcgtctttcctctggctccaagtctggcaactccggcctccctgaccatcgtcgggctccgaggctggaggacgagctacttattatgactatttcattacagacacaaccaangtctggtgttcggcggagggaaccaaggttcgacccgttctcggtcacggccccaaggtcctcgcccccttggccactccgttcggttcccccg

SEQ ID NO: 303340 - DNA, 637 bp, Homo sapiens
  misc_feature: GZ8MTXP01C79E8.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaaccngccgtgactagttggtntacttaataactntcgtctctcgaccaacaacaccgagaccaaccgacccaactcatactatttangtatgtacagtcacgtccgtcctgtggtacgtttcgtcggtctcttcctcgtgtctacgacgtctcgcctaccgtccgtccctccgtacgacctcgtccggtccggtctccggaggtcgtaggaacggacgtacgtacttaactttattagtcgtacttatttacgaataacgaagaacgaacctaaccgtaacgtacggttacgtcgggtcggtacggggacgggtaacgggtaaccgtaacggttccggtacccgttccgtaccggtacaccggcccgttacggtcccgtcccgtccccgtcggtaccttaccttccgttcccgttccccg

SEQ ID NO: 303341 - DNA, 552 bp, Homo sapiens
  misc_feature: GZ8MTXP01DDUKZ.25.22.B11.1.454.CMB.2.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (459)..(459): a, c, t, g, unknown or other
  misc_feature (459)..(459): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcggtcaccatctcctgcactggaacccngccgtgactattgggtntcttataaactatgtctcctggtcccaacaacacccaggcaacggccccaaatcatcatttangatgtcagtcatcggcccttntggtagtttctggtcgtctttcctctggctccaagtctggcaactcggccctcctgaccatcgtcggggctccgaggctggaggacgaggtcttacttagttatgtctatttcaattacaagacacaaccaaacngttcgtaggttgtcggcgggagggtaacaaggttcgacccgttctcgggtcacgccaaggcctcgccccgttggccttactccttcgttcccc

SEQ ID NO: 303342 - DNA, 733 bp, Homo sapiens
  misc_feature: GZ8MTXP01EDL1A.25.22.B11.1.454.CMB.2.raw
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtagactagttgggtntactttaataacttnttcgtctccgtacgtacccaacaaccaccgacgaccaaccgaccccaactcatactattatagtatgtactagtctacgtccgtcccttgttggttacgtttcgtcggtctcttccgtcgtcgtcctaccgtacgtcgtacgtccgtaccgtcccgtccctcccgtacgtacccgtacgttcccgggtcccgggtacctaccggacggtacgtaacgggaacgggtaacggtacggttacttaacgtttaacgttacgttacgttacttactttacgtaacgtaacgtaacgtaacgaaccgaaccgtaacgtacgttacggttcgggttcgggttaccgggtacgggtaacgggtaaccggtaacggttaccggtacccggttaccggtaccggtaccggaccggacccggttaccggtcccgtcccggtccccgttcccggtacccgttacccgttcccgttccccgttaaccccg

SEQ ID NO: 303343 - DNA, 790 bp, Homo sapiens
  misc_feature: GZ8MTXP01CADM6.25.22.B11.1.454.CMB.2.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctcgtgtctgggactccgtggacngtcggtcaccntctcctgcatggaaccngccgtgactagttggntactttaataactnttcgtcctccgtcggtaccccaacaaccaccccgaggacccaaaccggaccccccaaaatcaattctaatttatgaatgtcagtacacgtccggcccttcgtggtacgtttcgtcggttcgtctttccctcgtacggtcctaccgtaagttccgtacggtcctaaaccgtcccgggtcccttccccgtacggaaccccttacgttcccgggttacccgggggtaccttcccggaacggggtccgttacgggaaacggggtaacccggtaaacgggttaccgtttaaacctttaaagtttacgtttcggtactttaaccggttttacgtaaactttaaccgaaacgtaaccggtaaaccaaaccgtaaacgtacggttcgttacggggttacggttaccgggacgggtaacgggtaaaccccgttaaggttaccggtaacccggttccgtaccgggttaccgaccggacccgttaaacgggtcccgtacccggtcccccgttcgggtcccttaccgtttcccgttccggtttcccccccg

SEQ ID NO: 303344 - DNA, 622 bp, Homo sapiens
  misc_feature: GZ8MTXP01DAI92.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (446)..(446): a, c, t, g, unknown or other
  misc_feature (446)..(446): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattggncttaanaactntcgtctcctgtacccaacaacacccaggaccaaacggccccaaaactcatcatttangatgtcagtcatccggcctcgtggtagtttcngggtctctttcctcgtggacctaccaagtctcggcctaacgtccgcccttccngaccntccgtcgggctccgaggctaggacggaccgtaggtacttaacttattacttntacttaattacgaataacgaagaacgaacctaacgtaacgtagttcggtgggtcgggtacgggacgggaacgggtaacctaaggttccggtacccgttcggtaccggtacgaccggacccggaccggtcccgtccccgtccccgtcgtaccttaccgttcccgttcccgttccccg

SEQ ID NO: 303345 - DNA, 514 bp, Homo sapiens
  misc_feature: GZ8MTXP01A1VFN.25.22.B11.1.454.CMB.2.raw
  modified_base (234)..(234): a, c, t, g, unknown or other
  misc_feature (234)..(234): n is a, c, g, or t
  modified_base (490)..(490): a, c, t, g, unknown or other
  misc_feature (490)..(490): n is a, c, g, or t
tcagactgtacagtcacgaccggtgctcgatttagacgacagctcagggggggtctcaggaggcagcgctctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcttggtncttatgacactgtctctggcaccagtttacccaggaaacgcccccagagtcatcctttatgatgtcaggaagccggccctcgacgggggtccctgactccgcttctcgtgggtcccaaaatctggcaacaccggccctccctgaccatctctgggctcgagctgagatgaggctgattattatgtcttgtcatatgcaggctaactctagtttggtgttcgcgtcagggacctaaggttcgaccgttcgtgggtcncgcccgaggcctcgccccgtccgg

SEQ ID NO: 303346 - DNA, 530 bp, Homo sapiens
  misc_feature: GZ8MTXP01ADE2H.25.22.B11.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
  modified_base (496)..(496): a, c, t, g, unknown or other
  misc_feature (496)..(496): n is a, c, g, or t
  modified_base (522)..(522): a, c, t, g, unknown or other
  misc_feature (522)..(522): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgccactggaaccagccgtgacattgggtgctttaanaactntgtctcctggtaccccaacaacaccccaggcaacggcccccaaactcatcatttangatgtcagtcatcggccctctggtagtttctggtcgcttcctctggctcaagtctggcaactccggcctccctgaccatccgtcggggctccgaggctgaggacgaggctacttattacttgctatttcatacaganacacacagtctggtgttcggccggtaggaacctaagttcgacgttcctcggtcngccaggcctcgccccgtggtcactcncgttcccc

SEQ ID NO: 303347 - DNA, 518 bp, Homo sapiens
  misc_feature: GZ8MTXP01CCE7C.25.22.B11.1.454.CMB.2.raw
  modified_base (234)..(234): a, c, t, g, unknown or other
  misc_feature (234)..(234): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtncttataactatgtctcctggtcccaacaacacccaggcaaggcccccaaatcatcatttatgatgtcagtcatcggccctntggtagtttctggtcncttcctctggctccaagtctggcactcggcctcctgaccatctcgggctccaggctgaggacgnggctactattattgactatttcattacagaanacacaacngtactggtgttcggcggagggaaccaagttgaccgttcgtcggtcacgccaaggctcgcccctggtcactccgttcgttcccc

SEQ ID NO: 303348 - DNA, 547 bp, Homo sapiens
  misc_feature: GZ8MTXP01CMAFL.25.22.B11.1.454.CMB.2.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (517)..(517): a, c, t, g, unknown or other
  misc_feature (517)..(517): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaacggccccaaatcatcatttangatgtcagtcactcggcccttctggtagtttctggtcgtctttcctctggctcaagtctggcaacgtcggcctccctgaccatcgtcgggctccgagctggaggacgaggctacttattattgactatttcgattacgagacgaccaacctaacgagttcgtggtcgttacgggcggtaggtaacctaagttcgaccgttcgtcggtcacggccaggtccncgtcccctggtccacctcgttcgttccccc

SEQ ID NO: 303349 - DNA, 530 bp, Homo sapiens
  misc_feature: GZ8MTXP01B6LT0.25.22.B11.1.454.CMB.2.raw
  modified_base (235)..(235): a, c, t, g, unknown or other
  misc_feature (235)..(235): n is a, c, g, or t
  modified_base (436)..(436): a, c, t, g, unknown or other
  misc_feature (436)..(436): n is a, c, g, or t
  modified_base (503)..(503): a, c, t, g, unknown or other
  misc_feature (503)..(503): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataaactatgtctcctggtcccaacaacacccaggcaacggccccaaaactcatcatttatgatgtcagtcatcggccctctggtatttctggtcgcttcctctggctccaagtctggcaactcggcctcctgaccatctcgggctccaggctgaggacgaggtctaacttattattcgactatttcgaattacaganaacacaaacagtctggtgttcggcgtagggaaccaagttcgaccgttctcggtcacggccaaggtcncgtcccctggtccactccttgttcccc

SEQ ID NO: 303350 - DNA, 536 bp, Homo sapiens
  misc_feature: GZ8MTXP01DU7MA.25.22.B11.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (438)..(438): a, c, t, g, unknown or other
  misc_feature (438)..(438): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgacattggtncttataactntgtctcctggtcccaacaacacccagcaacgccccaaactcatcatttangatgtcagtcatcggccctctggtagttttctggtcgctttcctctggctccaagtctggcaactcggcctccctgaccatctcggggctccgagcgtgaggacgagtcttacgttattatgactatttacgaattacgaaganaacaaccaagagttcgtggttggtcggacggaggaactaagttcgaccgttcgtcgnacgccgacggtcnccgccccgtgccttactcttcgtccccc

SEQ ID NO: 303351 - DNA, 521 bp, Homo sapiens
  misc_feature: GZ8MTXP01CECC4.25.22.B11.1.454.CMB.2.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggaaccagccgtgacatttggntcttaataactntgtctcctgtcccaacaacaccagcaacggccccaaatcatcatttatgatgtcagtcatcggccctntggtagtttcngtcgtcttcctctgctcagtctgcactcgcctcctgaccatcgtcgggctccgaggctggaggacgaggtcttacgttattattgctatttcattacanacgacacaatgtactggtgttcggcggaggaaccaagttcgaccgttcgtcggtcacgcccaggctccgcccctcggtcacgttccgttcgttcccc

SEQ ID NO: 303352 - DNA, 542 bp, Homo sapiens
  misc_feature: GZ8MTXP01D5JCV.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (372)..(372): a, c, t, g, unknown or other
  misc_feature (372)..(372): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgactattggtnctttaataactatgtctcctggtcccaacaacacccaggcaaggcccccaaatcatcatttatgatgtcagtcatcggccctctggtatttctggtcgcttcctctggctccaagtctggcaactccggcctccngaccatcgcgggctcaggctggagacgaggctacgttattatgactatttcatacaganacaaccanagtctggtgttcggcgggaggaactaaggttcgacccgttcgtcggtcacggttcccaaggtcctcgcccccttcgggtccaccttccgttccgttaaccccc

SEQ ID NO: 303353 - DNA, 529 bp, Homo sapiens
  misc_feature: GZ8MTXP01D4F5K.25.22.B11.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (431)..(431): a, c, t, g, unknown or other
  misc_feature (431)..(431): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtgcttaataactatgtctcctggtcccaacaacacccaggcaacggcccccaaatcatcatttangatgtcagtcatcggccctntgtagtttctggtcgcttcnctgctcagtctgcactcgcctcctgaccatcgtcggggctccgaggctgaggacgaggtcttacttattattgactatttcaattacaganacaccaacagtcgtggtcgttcggcggagggaacctaaggttcgaccgttccgtcgtcacgccagggcctcgcccctcggcacgtcttcgttcccccg

SEQ ID NO: 303354 - DNA, 581 bp, Homo sapiens
  misc_feature: GZ8MTXP01B8UZO.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (374)..(374): a, c, t, g, unknown or other
  misc_feature (374)..(374): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtntcttataactntcgtctcctggtcccaacaacaccaggcaacgccccaaactcatcatttangatgtcagtcatcggccctgtggtagtttcgtggtcgtctttcctctggtctccagtctcggcactcggcctccngaccatcgtcgggctccgaggctgacggacgaggtacttacgttattattgacttactttcgattacagtaacgaccaaccgaatagttcgtgggtcggttcggcgggacgggtaaccgtaaggttcgaccgttccgtcggtcacggcccgaacggtccgtcccgtcccccgttcgggtccttaccgttccgttccggtttcccccg

SEQ ID NO: 303355 - DNA, 512 bp, Homo sapiens
  misc_feature: GZ8MTXP01DM1NI.25.22.B11.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (432)..(432): a, c, t, g, unknown or other
  misc_feature (432)..(432): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactntgtctcctggtcccaacaacacccaggcaacggccccaaactcatcatttangatgtcagtcatcggccctntggatttctgtcgcttctctggctcagtctgcaactcgcctccctgaccatctcggggctccgaggctggaggacgaggtcttacttatattgactattcatacagagacacangtctgtgtcggcggaggaacaagttcgaccgttcgtcggtcacgccaggctcgcccctggtcacgtcgttccgttccccg

SEQ ID NO: 303356 - DNA, 519 bp, Homo sapiens
  misc_feature: GZ8MTXP01A50QY.25.22.B11.1.454.CMB.2.raw
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
  modified_base (504)..(504): a, c, t, g, unknown or other
  misc_feature (504)..(504): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactgggaacccagccgtgacattgggtnctttaataactatgtctcctggtcccaacaacaccaggcaacggccccaaatcatcatttatgatgtcagtcatcggccctntggagtttctggtcgcttctctggctcagtctggcactcgcctcctgaccatcgtcgggctccgaggctgaggacgaggtctacttattatgctatttcatacagagacacacagtctggtgtcggcggaggaacctaaggttcgaccgttcgtcggtcacgcccttaggctcgcccctcggtcncgtccgttcgtcccc

SEQ ID NO: 303357 - DNA, 547 bp, Homo sapiens
  misc_feature: GZ8MTXP01AMVDV.25.22.B11.1.454.CMB.2.raw
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcgtggtttcctgtgctctagtaaaggtgtccattgtcaggtgcagttggtgcagtcgtgggggagcttcgtcaagcctggacgggtccctgagactctcctgtgaagtctctggattcaccatcaatgacttactttanggcctggactccgccaggctcgaggggagggctgggagtggatttcatttancagtagtggagtanggactattaatatccagtacctcgtcggaggggccctcttcaccatcnccgagggacacggaccacaatcaacttcgttctagggactaagtcgaacgtaccgccgacgccgacggacacggtctcgtctntgttgnggagtaggttggggttattgttgaatgcgtagtcgttactaacccgttaacccttaag

SEQ ID NO: 303358 - DNA, 598 bp, Homo sapiens
  misc_feature: GZ8MTXP01CLTCH.25.22.B11.1.454.CMB.2.raw
  modified_base (235)..(235): a, c, t, g, unknown or other
  misc_feature (235)..(235): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcgtcaccatctcctgcactggaaccagccgtgactattgggtntacttaataacttatcgtctcctcggtcccaacaacacccaggcaacggccccaaactcatctatttatgatgtcagtcagtccggcccttgtggtagtttcgtggtcgtcttcctctggctcaagtctggctactcgggcctccctcgacctactccgtcgggctccgaggtctaggaggacgtaggtacttacttattacttgcttatttcgaattacagacgacaaccaaagtacgttaccgtggtacggttcggacgggaacggtaaccgtaaggttcgacccgttccgtaccggtcaccggcccgaaggtcccgtccggtccccttcgggtccttaccgttccgttcccgttcccccg

SEQ ID NO: 303359 - DNA, 543 bp, Homo sapiens
  misc_feature: GZ8MTXP01A2CMF.25.22.B11.1.454.CMB.2.raw
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattgggtnctttaataactatgtctcctggtcccaacaacacccaggcaacggcccccaaatcatcatttatgatgtcagtcatcggccctntggagtttctggtcgtcttcctctggctccaagtctggcactcggcctccctgaccatcgtcggggctccgaggctggaggacgaggtcttacgttattatgctatttcattacaagacgaacaccactagtctggtgttcggacgggaggaacctaagttcgacccgttcgtcggtcacgcccaaggcctcggcccctcggtccacttcgttcgttccccc

SEQ ID NO: 303360 - DNA, 527 bp, Homo sapiens
  misc_feature: GZ8MTXP01BST98.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (445)..(445): a, c, t, g, unknown or other
  misc_feature (445)..(445): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttaataactntgtctcctggtcccaacaacaccaggcaacggccccaaactcatcatttatgatgtcagtcatcgccctntggtatttcngtcgtcttcctctgctcagtctgcactcgcctcctgacatcgtcgggctcgagctgagacgagctacttattatgactatttcatactaagagacaccaatgttacgtggtggttcggnggagggaacctaaggttcgaccgttcgtacggtcacgccaacggcctcggccccttcggtcaccgttcgttcggttcccccg

SEQ ID NO: 303361 - DNA, 523 bp, Homo sapiens
  misc_feature: GZ8MTXP01C8UZG.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (369)..(369): a, c, t, g, unknown or other
  misc_feature (369)..(369): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (506)..(506): a, c, t, g, unknown or other
  misc_feature (506)..(506): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtntcttaataactatgtctcctgtcccaacaacaccagcaacgccccaaatcatcatttatgatgtcagtcatcggccctctggtagtttctggtcgcttcctctggctcagtctggcactcgcctccctgacntctcgggctccgagctgaggacgaggtcttactattatgtactatttnaattnaaganacaaccaactgtactggtgttcggcggaggaacctaaggttcaccgttcgtcgtcacgccaggcctcgccccgttcgcncgttccttcgttccccg

SEQ ID NO: 303362 - DNA, 578 bp, Homo sapiens
  misc_feature: GZ8MTXP01C7TBI.25.22.B11.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (417)..(417): a, c, t, g, unknown or other
  misc_feature (417)..(417): n is a, c, g, or t
tcagactgtacagtcacgaccggtgctcgatttagacgacagctcgagggggggtctcaggaggcagcgctctcgggactctccaccatggcctgggctctgctgttcctcaccctcctcactcagggcacagggtcctgggcccagtctgccctgactcagcctgcctccgtgtctgggactcctggacagtcgtcacatctcctgcactggaaccagccgtgactattggtncttaataactntcgtctcctggtacccaacaacaccagcaacgcccaaactcatcattatgatgtcagtcactcggccctcgtggtagtttctggtctcttcctctggctccaagtctggctaactcgccctcctgacctatcgtcgggctccgagcgtgaggacgaaggtctacttatattntctatttactattaacacgacgaacaaccaacaacgtcgtggtggttcgggtcgggacgggtaacgtaacgttacggtaaccgttccgtcggtacgacgcccgaacggtccgtccgtccccgttcccgggtccgttaccgttcccgttccgtttccccccg

SEQ ID NO: 303363 - DNA, 652 bp, Homo sapiens
  misc_feature: GZ8MTXP01AQNOW.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctccttactcagggcacagggtcctgggcccagtctgccctgactcagcctgcctccgtgtctgggactcctggacagtcggtcaccatctcctgcactggaaccagccgtgacattggtgtcttaataactatgtctcctggtcccaacaacacccagcaacggccccaaactcatcattatgatgtcagtcatccggccctctggtagttctggtcgcttctcctggtctccagtctaggcctaaccgtccgggccctcccgtcgacctacgtcgtccgggggccttcccgagggtcctacgggacgggacggacgggtaccttaactttacgttaattcgccttaattttccaattaccaaggaacgaaccaacccaaactacggttacgtcgggttacgggttccgggacggggaacgggtaccgtaaaggttccggaacccggttcccgttcggtaccgacggttaccccgaagggttccctccggtcccccgtcgggtccctccttccgttccgtttcccccgtaaccccc

SEQ ID NO: 303364 - DNA, 701 bp, Homo sapiens
  misc_feature: GZ8MTXP01B0V0Q.25.22.B11.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactgttggntacttaataactnttgtctcctcgtaccaacaacaccagaccaacgacccaactcactactatttatgatgtactagtcacgtccgtcccttcgtggtacgtttcgtcggtctcttcctcgtcggtacctacctaacgtcgtcggtctaccgtcccgtccctcccgtacgacctacgtccggtccgggcctccggacggtcgtagggaacgggtaccggtacggttacttaacgtttattacgttcgtacttaactttacgaaacttaacgaaacgaacgtaacctaaccgtaaacgtacggttacggttcgggttacgggttaccgggacggggtaacgggtaaccgttaaacgggttccgggtaacccggttccggttaccgggtaccgaaccgggttaccccgaacgggtcccgtcccggtcccccgttcggtacccttaccgttcccgttcccggttaacccc

SEQ ID NO: 303365 - DNA, 526 bp, Homo sapiens
  misc_feature: GZ8MTXP01BMYS2.25.22.B11.1.454.CMB.2.raw
  modified_base (236)..(236): a, c, t, g, unknown or other
  misc_feature (236)..(236): n is a, c, g, or t
  modified_base (317)..(317): a, c, t, g, unknown or other
  misc_feature (317)..(317): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctcctggtcccaacaacacccaggcaacggccccaaatcatcatttatgatgtcagtcatcggccctntggtagtttctggtcgtcttcctctggctcagtctggcactcgcctcctgaccatctcgggctccgaggctggaggacgagtcttacgttattattgctatttcgattacagacgactaccaacagtctggtgttcggcggaggaactaaggttcgaccgttcgtcggtcacgcccaaggctcgcccctcggtcactccgttcgtcccc

SEQ ID NO: 303366 - DNA, 527 bp, Homo sapiens
  misc_feature: GZ8MTXP01B2O4Q.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtnctttataactntgtctcctggtcccaacaacacccaggcaaggcccccaaactcatcatttatgatgtcagtcatcggccctcagggggtcccctgatcgcttcctctgggtccaaatctggcaacacggcctccctgaccatctctgggctccgaggctgagatgagctgattattattgctgttcatatgcaggcaaacgttctagttttggtgtttcggcgcgagggtaccaaggttcgaccgttcgttcgggttcaagcccgaaggcctcgcccctcggttcctccg

SEQ ID NO: 303367 - DNA, 514 bp, Homo sapiens
  misc_feature: GZ8MTXP01B4YN8.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttatactatgtctcctggtcccaacaacacccaggcaacggcccccaaaactcatcatttatgatgtcagtcatcggccctntggagtttctggtcgctttcctctggctccaagtctggcactcgcctcctgaccatctcgggctccaggctgaggacgaggtctacttattatgctatttcatacagagacacaacagtctggtgtcggcggagggaaccaagttgaccgttcgcggtcacgccaggctcgcccctggcactcgttcgttccccg

SEQ ID NO: 303368 - DNA, 649 bp, Homo sapiens
  misc_feature: GZ8MTXP01DF6P3.25.22.B11.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (310)..(310): a, c, t, g, unknown or other
  misc_feature (310)..(310): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgactagttggntacttaataactntcgtctcctcgtacccaaacaacaccccaggaccaaacggacccccaaatcatctatttangatgtcagtcatccggcccttgtggtatttcgtggtcgtctttcctctcggcctaccgaagttccgtcgggcctaaccgtcccgggcccctcccgtacgaccctagtcccggtcggggcctccgagggctaggaacggaacggtacggtacttaacttagttaacttcgtacttatttacaagttaacaaagacgaaccaacctaaacgcgttacggtgggttcggttacgggacgggagggtaacctaaggttcggacccgttgtccggtacaccggttcccgaaggtccctacccggtccccgtcgggtaccttacgtcccgttcccgttaaccccc

SEQ ID NO: 303369 - DNA, 520 bp, Homo sapiens
  misc_feature: GZ8MTXP01D5DEH.25.22.B11.1.454.CMB.2.raw
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (462)..(462): a, c, t, g, unknown or other
  misc_feature (462)..(462): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggaggcttcgtcaagcctggagggtccctgagactctcctgtgaagtctctggattcaccatcaatgactacttatggctggatccgcaggctccgagggagggctggagtggatttcatttancagtatggagtatgganatttnatcagactcncgagggccnctcacatctcagggacacgcacancaactcttcngacaagtcgaacgcgtcgagcgagcgacggcgtgtacttctgttgcgaggnggtttgggggttattgttgtaatgccgtagtggttactaacccgttaacccgttaacc

SEQ ID NO: 303370 - DNA, 521 bp, Homo sapiens
  misc_feature: GZ8MTXP01BB6U3.25.22.B11.1.454.CMB.2.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggcccccaaatcatcatttangatgtcagtcatcggccctctggatttctggtcgcttcctctggctcaagtctggcaactcggcctcctgaccatctcgggctccaggctgaggacgaggcttacttattattgctatttcattacagtagacacaacagtctggtgttcggcggtagggaacctaagttcgaccgttcgtcggtcacgcccaagggtcctcgcccctggcacgtcttcggtcccc

SEQ ID NO: 303371 - DNA, 732 bp, Homo sapiens
  misc_feature: GZ8MTXP01EPVGN.25.22.B11.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaccagccgtgactattgggtnacttaataacttntcgtctccgtcgtaccaacaacaccgacgacaaccgacccaatcatactatttatagtatgtactagtactacgtccggtcccttcgttggttacgtttcgtcggttccgtctttcccgtcgtcgtcctaccgtaacggtccgtacggaacctaaccgtcccggtccctcccgtacgtacctctccgtcggacgtccgtaccgacgggtcgtacgggaacgggtacggtacggtacctttaacgtttagttacgttacgtacttacgtttactaacgttaaacgaacgtaaaccgaaaccctaaaccgtaacgtacggttccggttcggggttacgggttacccgggggacgggtaaaccggggtaacccgttaacgggttacccggttacccggttcccggtaccgggttaccgaccggacccggtaacggtcccgttcccggtccccggttcggttccttaacccgtttcccgttccccgg

SEQ ID NO: 303372 - DNA, 560 bp, Homo sapiens
  misc_feature: GZ8MTXP01EY86F.25.22.B11.1.454.CMB.2.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccngccgtgactagttggtnctttaataactntgtctcctggtcccaacaacacccaggcaacggcccccaaatcatcatttatgatgtcagtcatcggccctntggtagtttcnggtcgcttcctctggctcagtctggcactcgcctcctgaccatcgtcgggctccaggctggaggacgaggtctacgttattactgctatttcattacagacgacaccaatagtcgtggtcgttcgggcggagggaacctaaggttcggacccgttccgtacgggtcaacggcccgaacggccttcccggcccccttcgggccttaccggttccttccgttcccccc

SEQ ID NO: 303373 - DNA, 524 bp, Homo sapiens
  misc_feature: GZ8MTXP01CN0D3.25.22.B11.1.454.CMB.2.raw
  modified_base (325)..(325): a, c, t, g, unknown or other
  misc_feature (325)..(325): n is a, c, g, or t
  modified_base (428)..(428): a, c, t, g, unknown or other
  misc_feature (428)..(428): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataaactatgtctcctggtcccaacaacacccaggcaacggccccaaactcatcatttatgatgtcagtcatcggccctctggatttcnggtcgcttcctctggctccaagtctggcaactcggcctccctgaccatctcggggctccaggctgaggacgaggctacttattattgctatttcattacaganacaccaaacagtactggtgttcggcggagggaaccaaagttgaaccgttccgtcgggtcagcccaaggcctcgccccctggtcacctcttgtcccc

SEQ ID NO: 303374 - DNA, 601 bp, Homo sapiens
  misc_feature: GZ8MTXP01DG408.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcgtcaccatctcctgcactggaaccngccgtgactagttggtntcttaataactntcgtctcctggtacccaacaacaccagcaacgccccaaatcatcatttatgatgtcagtcactcggcccttgtggtagtttctcggtcgtctttcctctggtctccaagtctggctaacgtcggccctccctcgacctntccgtcggggcctccgaggctgacgggacgtaggtcttaacttattatcgtcttatttacattaacagtaacgacaaccaagtagtaccgtgggttggttacgggcggaagggtaacctaaggttccggtaaccgttccgttacgggtcacggcccacggtcctcccgtcccccgtcgggtccttaccgttcccgttccgtttaaccccccg

SEQ ID NO: 303375 - DNA, 610 bp, Homo sapiens
  misc_feature: GZ8MTXP01BD2NW.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattggtncttaataactatgtctcctggtcccaacaacacccagcaacggccccaaacncatcatttangatgtcagtcatcgccctntggtagtttctgtcgtcttcctctgctccaagtctgcaactccggccctccctcgaccatccgtcggggctccgaggctggacggacgaggtacttaactttattaattcgacttatttcaattaacagaacgacaaccaaacgtagttccgtggttcggttacgggacgggtaaggggtaacctaaaggttcgggaacccgttccggtaccggttccgaaccggcccgaaacgggtccctcccggtcccccgttcgggtccttaacccgttccgttcccggtttcccccccg

SEQ ID NO: 303376 - DNA, 586 bp, Homo sapiens
  misc_feature: GZ8MTXP01BLA5O.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattgggtncttaataactntgtctcctggtcccaacaacacccagcaacggccccaaatcatcatttangatgtcagtcatcggccctntcggtagtttctggtcgtcttcctctggtctccgtaagtcgtcggctaacgtccggccctccctcgacctactcggtccgggtctaccgaggcgtggaggaacggtaggtcttaattacttattgtacttactttacgaattaacagaacgaccaaccgaactacgtccgttagggtcgttcgggacgggtacgggaactaggttcgtacccgttcgtcggtcacgccgaacggctccgtcccctcggtccacgtccttcgttcccc

SEQ ID NO: 303377 - DNA, 517 bp, Homo sapiens
  misc_feature: GZ8MTXP01BLF4B.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattgggtncttataactntgtctctgtcccaacaacacccagcaacgccccaaatcatctatttangatgtcagtcatcggccctgtggagtttcgtgtcgtcttcctctggctcagtctggcaactcggcctccctgaccatccgtcggggctccgaggctgacgacggngtctacttattacttgctattcatacagagacacaanagtcgtgtgtcggcgaggaacctaagttcgaccgttcgtcgtcacgccaacgcctcgcccctcggcaccgtcttcgtcccc

SEQ ID NO: 303378 - DNA, 585 bp, Homo sapiens
  misc_feature: GZ8MTXP01C56N6.25.22.B11.1.454.CMB.2.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattgggtncttaataactatgtctcctggtcccaaacaacacccaggcaaggccccaaatcatcatttangatgcagtcatcggccctntggtatttcnggtcncttcctctggctccaagtcctggctaactcggcctcccngaccatccgtcgggctccgaggtctggacggacgaggtcttaacgttattaattcgactacttttcgaattaacaacgtacgaccaaccaaacgagttccgtgggtcggtttcggcgggtaagggaaccctaaaggttcgacccgttacgttccgggtcacgttccccgaaggcctcgcccccttcgggtaccaccgttccgttcgttaaccccc

SEQ ID NO: 303379 - DNA, 548 bp, Homo sapiens
  misc_feature: GZ8MTXP01ESVNO.25.22.B11.1.454.CMB.2.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattgggtnacttaataactatcgtctcctggtacccaacaacacccaggcaacgacccccaaatcatcatttatgatgtcagtcatccggccctctggtagtttctggtcgtcttcctcgtgctcctaagtctggcactccggcctccctgaccatccgtcgggctccgaggctgaggacgaggtctacgttattnttgactatttcatacgagacaacaccaanagtcgtggtgtcggcggagggaacctaagttcgaccgttccgtcgtcacgcccgaaggcctcgccccgtggtccacttcgttccgttccccg

SEQ ID NO: 303380 - DNA, 662 bp, Homo sapiens
  misc_feature: GZ8MTXP01DWB74.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
tcagactgtacagtcacgaccggtgctcgatttagacgacagctcgaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttanaaactntgtctctcgtaccaacaacaccagacaacgacccaatcatctatttatgatgtcagtcacgtccggtccctcgtggtagtttcgtggttcgtcttcctcgtcggtctaccgtaagtactacggcctaaccgtccggtccctcccgtacgacctacgtccgtcggggcctccgacggtcgtaggaacggacgtacgtacttaacttaattacttcgtacttactttacgaaacttaacgaacgaacgaaccaacctaaacgtacgttacgtgggttcggttaccgggacgggtaacgggtaaccgttaaacggttccggtacccgttccgttaccgggtaccgaacggcccgttaacgggtcccgttacccggtcccccgttacgggtacccttaccgttcccgttccgttcccccg

SEQ ID NO: 303381 - DNA, 636 bp, Homo sapiens
  misc_feature: GZ8MTXP01CLWDM.25.22.B11.1.454.CMB.2.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
  modified_base (518)..(518): a, c, t, g, unknown or other
  misc_feature (518)..(518): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcgtcacatctctgcactggaaccngccgtgactagttgggtntactttaataactatcgtcctccgtacggtacccaaacaacacccgaggaccaacgacccccaaatcatctatttangatgctagtcacgtccggcccttgtgggtagtttcgtggttccgtctttcccgtcttcggccttaccaagttccgtacgggcctaaccgttcccggtcccttccccgtacgaccctacgttcccggtccggggtcttaccggacggcgtaggaacgggacgtaacggtccttaaacgtttattagttcacttattacaataacgaanacaaccaacaacgtgtcgtggtcgtcgggacggaggaacgtaaggttcgtacgttccgtcggtaccacgttcccgacgcgtcccgtcccgtcggccttccttcccgttccgttccccc

SEQ ID NO: 303382 - DNA, 508 bp, Homo sapiens
  misc_feature: GZ8MTXP01DQV8P.25.22.B11.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (422)..(422): a, c, t, g, unknown or other
  misc_feature (422)..(422): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgtcttataactatgtctcctgtcccaacaacaccaggcaacggccccaaactcatcatttangatgtcagtcatcgccctntggatttctgtcgtcttcctctggctcagtctggcacgtcggccctcctcgactactcgtcgggctccgagctgaggacgagtctacttatatgctattcatacanacgacacacagtctggtgtggcggaggaacaagttcgaccgttcgtcgtcacgccacggctcgcccctggcactccgttcgtcccc

SEQ ID NO: 303383 - DNA, 649 bp, Homo sapiens
  misc_feature: GZ8MTXP01B505F.25.22.B11.1.454.CMB.2.raw
  modified_base (237)..(237): a, c, t, g, unknown or other
  misc_feature (237)..(237): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcgtcaccatctcctgcactggaaccagccgtgactagttgggtntcttaataactatcgtctcctggtacccaaacaacacccaggacaacgccccaaactcatcatttatgatgtcagtcatcgcctgtggtatttctggtctctttccgtctgcctccaagtctacggccaacgtccggccctcccgtgtacccagtcccgtcgggctccgacggctggaggacgagtcttacttattattcgtactatttcgtaactaccgaagacgaaccaaaccgtaaacgtaacgttaccgtgggttacggttaccggggacgggtaacggggtaacccctaaagggtttccggtaaccccgttcgttacccggtcgaaacccggttccccgaaaacggtcccgttcccgtccccccgttcgggtacccttaccggttcctttcccggtttaaccccccc

SEQ ID NO: 303384 - DNA, 526 bp, Homo sapiens
  misc_feature: GZ8MTXP01BOUH2.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggacctcctggacagtcggtcaccatctcctgcactggaaccngccgtgacattggtncttataactatgtctcctggtcccaacaacacccaggcaaggcccccaaactcatcatttangatgtcagtcatcggccctntggatttctggtcgcttctctgctcagtcngcactcggcctcctgaccatctcggggctccgaggctgaggacgaggtctacgttattactgctatttcattacagacgacaccacagtcctgggtgttcggcggagggaaccaggttcgaccgttcgtccggtcncgcccaaggcctcgcccctcggtcncgttccttcgttcccccg

SEQ ID NO: 303385 - DNA, 531 bp, Homo sapiens
  misc_feature: GZ8MTXP01BHPAL.25.22.B11.1.454.CMB.2.raw
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
tcagactgtacagtcacgaccggtgctcgatttagacgacagctcaggggggggtctcaggaggcagcgctctcgggacgtctccaccatggcctgggctctgctgttcttcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtcccaacaacaccagcaacgccccaatcatcatttangatgtcagtcatccggccctgtggtagtttctggtcgtcttcctctggctcagtctgcactcgcctcctgacatcgtcgggctcaggctgaggacgnggtcttacttattactgactatttcgattacagacgaacaccgaaactgtacgtggtcggttacggcgggaggaacctaagttcgacccgttcgtcggtcacggcccaggcctcgccccgtggccactccgttcggttcccc

SEQ ID NO: 303386 - DNA, 656 bp, Homo sapiens
  misc_feature: GZ8MTXP01EOCL9.25.22.B11.1.454.CMB.2.raw
  modified_base (291)..(291): a, c, t, g, unknown or other
  misc_feature (291)..(291): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcttgggttttccttgttgctcttgtaaaaggtgtccattgtcaggtgcagttggtgcagtcgtgggggaggcttcgtcaagcctggacgggtccctgagactctcctgtgaagtctctggattcaccatcaatgacttacttanggcctggactccgcaggctccgagggagggctgggagtggatttcagttancaagtaagtggaacgtaatggaactaatttaanaaactccgaagtactccgtaccgggacggggtcccgtccttaccacctacgtcctacccgaagggaacccgaacggccaaacaactacctaaacttctttaccgtcggaactaacggtacgaaacggtaccggtaccgacggacccggaagggaccaaccgggtccgttcgggtaacttcgttggttcggacggttaaggttacggggtttagggggttaattggttacgtaagtcggtaaccgttaggtcggtttaactaacccgttaaccccgttaacg

SEQ ID NO: 303387 - DNA, 559 bp, Homo sapiens
  misc_feature: GZ8MTXP01DFEGJ.25.22.B11.1.454.CMB.2.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (458)..(458): a, c, t, g, unknown or other
  misc_feature (458)..(458): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagtttgggtntactttaataaactattcgtcctccctggtaccccaaacaaaccaccccaggccaaacggacccccaaactcatcatttangatgtcagtcatcggccctcgtggtatttcnggtcncttcctctggctcagtcngcactcgcctcctgacntcgcgggctccgaggctaggacggacgaggtcttacttattattgactatttacaattacgaaganaaccaaccaacagtacgtgggtgttcggacggtagggaacctaagttcgaccgttcgtcgtcgacgccgaggctccgcccctggcacgttccttcgtcccc

SEQ ID NO: 303388 - DNA, 586 bp, Homo sapiens
  misc_feature: GZ8MTXP01EMU9R.25.22.B11.1.454.CMB.2.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcccggctcagtctgccctgactcagcctcgctcagtgtccgggtctcctggacagtcagtcaccatctcctgcactggaaccagaagtgatcttggtncttangacactgtctctggcacctagtttacccaaggaaacnccccagacgtcatccttatgtatgtacgaaggaacgcggccctgacgggggtccctgactcgtcttccgtccgtagggtaccaaatcgtacggaccaacgaccggccctccctgaccctatctcgtcgggctccgaggtctaggaggtagtgagtctgtattattattgtcttgttctattatgcgaggtactaaacgttacttagttttgggtacgttcggaacgtcgacgggtaccttaggttcgaaccggttcgttcgggttacaacggtcccgaagtcccgtcgttcccctcggttctaaccccg

SEQ ID NO: 303389 - DNA, 652 bp, Homo sapiens
  misc_feature: GZ8MTXP01CWCOG.25.22.B11.1.454.CMB.2.raw
  modified_base (240)..(240): a, c, t, g, unknown or other
  misc_feature (240)..(240): n is a, c, g, or t
tcagactgtacagtcacgaccggtgctcgatttagacgacagctcgagggggggggtctcaggaggcagcgctctcgggacgtctccaccatggcctgggctctgctgttcctcaccctcctcactcagggcacagggtcctgggcccagtctgccctgactcagcctgcctccgtgtctgggactctggacagtcgtcaccatctcctgcacgtggaaccagccgtagactagttggtntacttaataactattgtctcctggtacccaaacaacacccaggacaacggaccccaaactcaatctatttatgatgtcagtcactcggtccctgtggtagtttcgtggttcgtctttcctcgtaggtctacctaagttccgttacggctaaaccgtccgggtccctacccgtcgacctacgtccgtccgggggcttccgacgggtctcggaacgggaacgacgggtacttaacctttaattaagttcgtactaatttaccaagttacgaagaacgaaccaaccaaacctagtacgttcgggtggttacgggcggaaggggaacctaaagggttccgtaccgttcgtcggtacgacggcccaaagggtcctacccgtccccgtacggtcttaccttccgttccgtttcccccg

SEQ ID NO: 303390 - DNA, 874 bp, Homo sapiens
  misc_feature: GZ8MTXP01ECI2Z.25.22.B11.1.454.CMB.2.raw
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcggtcaccatctcctgcactggaaccagccgtagactagttgggtntacttaataactattcgtctcctacggtacccaaacaaccacccaggaccaacggacccccaaatcatctatttangatgtcagtcacgtccggcccttcgtggtacgttttcgtcggttccgtctttcccgtcgttcgggtcccttacccgtaacggttcccgtacgggtaacccgtaaaccgttccccgggtcccccttaccccgttacggaacccctacgtttccccggttacccggggggccctttccccgggaagggcccgttaaggggaaacgggtaacccgggtaacgggttacctttaaaccgttttaactttaatttcggtaccctttaagtttttacccgaaaatttaacccggtaaacgggtaaaccgtaaaccccgtaaaacccccaaaaaggttacggtttacccgggtttagggggtttcgggttttacccggggggaaccgggggtaaacggggtaaacccgttaaacggggttttcccgggaaaccccggtttcccggtaccgggggttacccaaaccggggcccccgttaaaccgggggtcccttaaccccggtcccccccggttccgggttacccgttaaaccttttcccgttttccccggtttccccccccgg

SEQ ID NO: 303391 - DNA, 544 bp, Homo sapiens
  misc_feature: GZ8MTXP01ARMW4.25.22.B11.1.454.CMB.2.raw
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
  modified_base (474)..(474): a, c, t, g, unknown or other
  misc_feature (474)..(474): n is a, c, g, or t
  modified_base (507)..(507): a, c, t, g, unknown or other
  misc_feature (507)..(507): n is a, c, g, or t
tcagactgtacagtcacgaccggtgctcgatttagacgacagctcagggggagctctgggagaagagccccagccccagagttcccaggagtttccattcggtgatcagcactgaacacagaggactcaccatggagtttgggctgagctgggttttccttgttgctcttagtaaaaggtgtccattgtcaggtgcagttggtgcagtcgtgggggagcttcgtcaagcctggagggtccctgagactctcctgtgaagtctctggattcaccatcaatgactacttanggcctggatccgcaggctccgagggggagggctggngtcggtatttcatttanctagtaatgggagtatcgatattnatcagtactcgtcggagggccncttcacctatctcgaggaaccacgccaacactcaacttcttacngacaagtcgaacgtcgcgacgccgtagcgtacggtctgtctntggttgcgagtgggttaggggttattgttacgntcgcgtaggtcgttacctaacccgttaacccgtaacg

SEQ ID NO: 303392 - DNA, 527 bp, Homo sapiens
  misc_feature: GZ8MTXP01A7GPE.25.22.B11.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (328)..(328): a, c, t, g, unknown or other
  misc_feature (328)..(328): n is a, c, g, or t
  modified_base (441)..(441): a, c, t, g, unknown or other
  misc_feature (441)..(441): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactntgtctcctgtcccaacaacaccaggcaacggccccaaactcatcatttatgatgtcagtcatcggccctctggtagtttcnggtcgtcttcctctggctcagtctggcactcggcctcctgaccatcgtcgggctccgaggctggagacgaggtactacttattattgactatttacatacagacgacacaacngtactggtgtcggcggagggaaccaaggttcgaccgttccgtcgtcacgccaggcctcgccccgtcggtcacgtcgttcgtccccg

SEQ ID NO: 303393 - DNA, 540 bp, Homo sapiens
  misc_feature: GZ8MTXP01EMMDS.25.22.B11.1.454.CMB.2.raw
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaaggcccccaaactcatcatttatgatgtcagtcatcggcccttctggagtttctggtcgtcttcctctggctcaagtctggcaactcggcctccctgaccatcctcggggctcgaggctgaggacgaggtctacttattattgctatttcgattacagaagacaaccaacagtcttggtgttcggcgggtagggaacctaagtttcgacccgttcgtcggtcacgttcccaaggctcgcccctcggtcactccttcgttcccccg

SEQ ID NO: 303394 - DNA, 562 bp, Homo sapiens
  misc_feature: GZ8MTXP01EX6MT.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttaataactatgtctcctggtcccaaacaacacccaggcaacggccccaaactcatcatttangatgtcagtcatcggccctntggatttcnggtcgtcttccnctggctcagtctggcaactcggccctcctgaccatcgtcggggctccgaggctgaggacgaggtcttacgttattatcgactatttcgaattaacagacgactaaccaaactgtcgtggtgttcgggcggagggaacctaaggttcgaccgttcgtcgggtacacggcccgaagggtccctcggtcccccttcgggtccttacttccgttccgttcccccg

SEQ ID NO: 303395 - DNA, 650 bp, Homo sapiens
  misc_feature: GZ8MTXP01A1DTV.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttggtgtcttataactatgtctcctgtcccaacaacacccaggcaacgccccaaatcatcatttatgatgtcagtcatccggccctcgtggtagtttcgtggttcgctttcctctaggcctccaagtctcggcaaccgtcggccctccctgaccacgtccgtccggggtctccgaggtcgtggacggacgaggtcttaacgtttattacgtttgactattttacgaattaaccgaagtaacgaaccaaaccctaaacgacgttcgtcgggttggttaccgggcggggtaaacggggtaaccctaaaggtttccggtaaaccccgttccgtaccgggttaccgaaccgggttccccgaaacggggtccctccggtcccccccgtcgggttcccaccctttccgttcccgtttccccccgg

SEQ ID NO: 303396 - DNA, 506 bp, Homo sapiens
  misc_feature: GZ8MTXP01CZWPG.25.22.B11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactggaaccngccgtgacattggncttataactatgtctctgtccaacacaccagcaagccccaatcatcatttatgatgtcagtcatcggccctcgtggtagtttctggtcgtctttctctggctccagtctggcactcggcctcctgacatctcgggctcgagctgaggacgaggctactattatgctatttcatacaganacacacagtctggtgttcggcgagggaaccaaggttnacccgttcgtcggtcagcccgaaggctcgcccctggtccacgtcttcgttaacccc

SEQ ID NO: 303397 - DNA, 564 bp, Homo sapiens
  misc_feature: GZ8MTXP01A6A0A.25.22.B11.1.454.CMB.2.raw
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcttgggttttccttgttgctcttgtaaaaggtgtccattgtcaggtgcagttggtgcagtcgtgggggagcttcgtcaagcctggaggtccctgagactctcctgtgaagtctctggattcacatcaatgactacttanggcctggatccgcaggctcgaggggagggctggagtggatttcatttancagtaatggagtaatggactatttnaatccagactcgtccggaggggcccncttcaccatcctccgagggaccaacggccaanaatcaaactctttcaggcaagtcgaacgacgtccgagcccggagacctacggcccgtagtaccttcgtgttggcgaggtaggttagggggttaggttagttgtaagtgtcgtacgtaggttacgtaaccgttaacccgttaacccg

SEQ ID NO: 303398 - DNA, 533 bp, Homo sapiens
  misc_feature: GZ8MTXP01ERKAZ.25.22.B11.1.454.CMB.2.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
  modified_base (519)..(519): a, c, t, g, unknown or other
  misc_feature (519)..(519): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtntcttaataactntcgtctcctgtacccaacaacacccaggcaacgccccaaatcatctatttangatgtcagtcactcggccctntggtagtttctggtcgtcttcctctgctccaagtctggctaacctcggccctccctgaccntccgtcgggctccgaggctgaggacgagtcttacttattatgactattcatacagacgacacaangtacgtggtgtcggcggaggaactagttcgaccgttcgcgtcacgccgaggcctccgtccccgtggtaccnctcgttccgtcccc

SEQ ID NO: 303399 - DNA, 562 bp, Homo sapiens
  misc_feature: GZ8MTXP01CMLSK.25.22.B11.1.454.CMB.2.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (454)..(454): a, c, t, g, unknown or other
  misc_feature (454)..(454): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgactattgggtgtcttaataactatgtctcctggtcccaacaacaccccaggcaacggcccccaaatcatcatttangatgtcagtcatcggcccttcgtggtagtttctggtcncttcctctggctcaagtctggcaactcggccctccctgaccctatccgtcggggctccgaggctgaggacgaggctacttattattgctatttcattacagacgacaaccanagttcgtggttggttcggcgggtacgggaacctaaggttcgacccgttcgtccggtcacgttcccaggtcctcgcccctacgggtccacgttccgttccgttcccccg

SEQ ID NO: 303400 - DNA, 528 bp, Homo sapiens
  misc_feature: GZ8MTXP01DSKWC.25.22.B11.1.454.CMB.2.raw
  modified_base (235)..(235): a, c, t, g, unknown or other
  misc_feature (235)..(235): n is a, c, g, or t
  modified_base (514)..(514): a, c, t, g, unknown or other
  misc_feature (514)..(514): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctctggtccaacaacaccagcaacggccccaaatcatcatttatgatgtcagtcatcggccctctggtagtttctggtcgtcttcctctggctcaagtctgcaactccggaccctccctgaccatcgtcggggctccaggctgaggacgaggctacttattattgctatttcattacagacacaccaacagtactggtagttcggcggaggaacctaagttcgaccgttccgtacggtcacgcccaaggctccgcccctcggtcnctcgttcgttcccc

SEQ ID NO: 303401 - DNA, 557 bp, Homo sapiens
  misc_feature: GZ8MTXP01DLEKM.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtntacttataactatgtctcctgtcccaacaacacccagcaacggccccaaactcatcatttatgatgtcagtcatcggcccttntggtatttctggtcncttctctggctccagtctggcaactcggccctcctgaccntcgtcgggcttccgaggctggacggacgaggtcttacgttattattgatatttacgattacagacgaccaccaactgtacgtggtgttcggcggagggaactaggttgtacccgttcgtacggttccacggttcccgaacggtccctaccgtcccctcgggtcaccttccttccgtttccccc

SEQ ID NO: 303402 - DNA, 627 bp, Homo sapiens
  misc_feature: GZ8MTXP01AHH71.25.22.B11.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (393)..(393): a, c, t, g, unknown or other
  misc_feature (393)..(393): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttgggtntactttaataactatcgtctcctcggtacccaacaaccacccaggccaacggcccccaaatcatctatttangatgtcagtcagtccggcccttgtggtagtttctggtcgtcttcctctggctccagtctgctacgtccggccctccgtgacnctcgtccgggctccgaggctaggaggtacgagtacttacgttattattgacttatttacgaattaacgagaacgaaccaaccgaacgtacgttccgttgggtacggttaccggggacgggtaacgggtaacgtaacggtttccggacccggtttccgacgggtacccgacggccccgaacggtcccgtcccgtcccccgtcgggtacccttacccgttccttcccgttcccccc

SEQ ID NO: 303403 - DNA, 573 bp, Homo sapiens
  misc_feature: GZ8MTXP01BOML9.25.22.B11.1.454.CMB.2.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtncttataactatgtctcctgtcccaacaacacccaggcaacggaccccaaatcatcatttatgatgtcagtcatcggccctntggtagtttctggtctcttcctcgtggctcctaagtctgctaactccggccctccctgacccatccgtcggggctccgaggcctggaggacgaggtacttacttattattgactatttcgaataacgagtaacgaacaaccgaaactagtccgttgggtcggttcgggacgggacgggtaacctaaggttcgaccgttccgtcggtcacggcccaggcctcgccccgtggtccttacctccgttccgttcccccg

SEQ ID NO: 303404 - DNA, 832 bp, Homo sapiens
  misc_feature: GZ8MTXP01BIBIV.25.22.B11.1.454.CMB.2.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacngtcgtcaccatctcctgcacgtggaaccngccgtgactagttggtnactttaataactattgtctcctggtacccaacaacacccaggcaacggaccccaaactcatctatttangtatgtcagtcacgtccggcccttgtggtacgtttcgtggttccgtctttccctcgtcggccttaccgaaggttccttacgggccctaaaccgttcccggggtaccccctttcccccgtacggtaccccgtacgttcccggtccgggggtcccttcccgaacggggtcccgttagggaacggggaaccggtacggggttacctttaaccgttttaacgtttaagtttcgtacttaactttttacgtaaactttaaaccgtaacgggtaaacgaacccgaaaaccctaaaccgtaagggtttacccggtttagggggtttccgggtttaccgggggaccgggggtaaaccggggtaaacccgggttaaacgggttttaccgggaaaccccgggtttcccggtttccgggggttacccgttaacccgggaccccggttaaaccggggtcccggttccccgggtccccccccggtttacggggttccccttaacccggtttcccgtttcccgggtttttaaccccccccg

SEQ ID NO: 303405 - DNA, 540 bp, Homo sapiens
  misc_feature: GZ8MTXP01CZK5E.25.22.B11.1.454.CMB.2.raw
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
  modified_base (486)..(486): a, c, t, g, unknown or other
  misc_feature (486)..(486): n is a, c, g, or t
  modified_base (506)..(506): a, c, t, g, unknown or other
  misc_feature (506)..(506): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttcctgttgctcttgtaaaaggtgtccattgtcaggtgcagttggtgcagtcgtgggggagcttcgtcaagcctggagggtccctgagactctcctgtgaagtctctggattcaccatcaatgactacttanggctgatccgcaggctccgagggagggctggagtggtatttcagtttancaaggtaatggaggtaaatggaactaatttgaaatccaaagcctcgtccggaggggcccncttcaccatctccgagggacacggcacaatcaactcttcngacaagtcaacgacgtccgacgccgaaggccacggccgtgtacctgtgcgngagtagggttggggttattngaatgctaggtgttactaacccgttaacccgtaa

SEQ ID NO: 303406 - DNA, 783 bp, Homo sapiens
  misc_feature: GZ8MTXP01AOTR0.25.22.B11.1.454.CMB.2.raw
  modified_base (220)..(220): a, c, t, g, unknown or other
  misc_feature (220)..(220): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattggtgcttataactatgtctctggtacccaacaacacccaggcaacggccccaaactcatctatttatgatgtacagtcactccggccctcgtggagtttctggtcgtctttcctcgtggtcctaccgtaagtccgtagggtcctaaaccgtcccgggccccttccccgtacgtacccctacgttcccggttcccggggggtaccttccccggaagggtccgttacgggaacgggtaacccggtaggggttaccctttaaaccgttttaagtttacttacggtacctttaaacgtttttccgaaactttaaaccgaaacgggtaaaccgaaaccctaaaccccgtaaaaccgtggttaaccgtttcgggggttcgggtttaccggggaaccgggggtaacggggtaaacccgtaaacgggttttaccgggaaccccgtttccggtaccccgggttaacgacccgggacccgttaaacggggtccccgttcccggtcccccccggttccggggtccccttacccgtttcccgttccccggtttaacccccccg

SEQ ID NO: 303407 - DNA, 554 bp, Homo sapiens
  misc_feature: GZ8MTXP01BO93R.25.22.B11.1.454.CMB.2.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (467)..(467): a, c, t, g, unknown or other
  misc_feature (467)..(467): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactggaacccagccgtgacattggtnctttaataactntgtctcctggtcccaacaacacccaggcaacggccccaaactcatcatttatgatgtcagtcagtcgccctntggtagtttctggtcgtcttcctctggctccagtcctggcaactccggccctccctcgaccacgtccgtcggggctccgaggcctggacggacgtaggacttacgttattattcgactatttcgattaacgagacgacaaccgaangtacgttggtgtcggcggaggaactagttcgccgttcgtcggtcacgccgaggcctcggcccctcggtccactccgttcgttccccg

SEQ ID NO: 303408 - DNA, 701 bp, Homo sapiens
  misc_feature: GZ8MTXP01BI5OP.25.22.B11.1.454.CMB.2.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacgagggtcctgggcccagtctgccctgactcagcctgcctcgtgtctgggactctggacngtcgtcaccntctctgcactggaaccngcctagactgttggtntacttaataactntcgtctcgtcgtaccaacaaccaccgacgaccaaccgaccccaactcaactactatttatagtatcgtacagtacacgtccgtccctgtggttcgtttcgtcgtcgtcttccgtcgtcgtctaccgtagtcgtacgtcctaccgtcccggtccctcccgtacgaccgtacgttcccggtccggggtcctaccggacggtcgtacgggacgggtacggtacggttacctttaactttaagttagttacgttacttactttacgtaacgtaacgtaacgaacgaacctaaccgtaacgtacggttacggttacgggttcgggtacggggacgggtaacgggtaaaccgttaacgggttccggtacccggttccggtaccggtaccgaaccggcccgttaaccggtcccgttacccgtccccgtcggtacccttaccgttcccgttcccgtccccg

SEQ ID NO: 303409 - DNA, 551 bp, Homo sapiens
  misc_feature: GZ8MTXP01ADYG6.25.22.B11.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (393)..(393): a, c, t, g, unknown or other
  misc_feature (393)..(393): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatcctctgcactggaaccagccgtgactattggtncttaataactntgtctctgtcccaacaacaccaggcaacggccccaaactcatctatttatgatgtcagtcactcggcccttcgttggtacgttttcgtggtcgtctttcctcgtcggctcccaagttcctggccaacgtccggccctccctgaccntcgtcggggctccgaggcgtgaggacgaggtcttacgttattattgacttattcgatacagacgacacacagtcgtggtgtcggcggaggctaagttcgaccgttcgtcggcacgccacggtcctcgccccgttcgtaccttctccgttcgttccccg

SEQ ID NO: 303410 - DNA, 531 bp, Homo sapiens
  misc_feature: GZ8MTXP01AUWPW.25.22.B11.1.454.CMB.2.raw
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggccccaaactcatcatttatgatgtcagtcatcggccctctggagtttcnggtcgcttccnctggctccaagtctggcaactcggcctcctnaccatctcggggctccgagctgaggacgaggctacttattatgctatttcatacagagacaccaacngtacgtggtgttacggcggagggaaccaagttcgaccgttccgtcggtcncgcccaaggcctcgccccctcggtccncttccgttccgttccccc

SEQ ID NO: 303411 - DNA, 666 bp, Homo sapiens
  misc_feature: GZ8MTXP01AVW57.25.22.B11.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccntcctcctgcactggaaccngccgtgactagttggtgctttaataactatcgtctcctgtcccaacaacacccaggccaacggacccccaaactcatctatttatgatgtcagtcactccggccctcgtggtagtttcgtggtcgtcttctctggtctccagtctcggcctacgtccgtccctccgtgacccagttccgtcggggccttccggacgggtcgtaggaacgggtaccggaggtacctttaactttaagttaattcgtacttacgtttactaacgtaaccgtaacggaaacgtaacccaaccgtaaaccgtaggttaccgttggggttacggttccggggtacgggaacggggtaacttaaacggttccggtaacccgttcggttccggtacgaccggcccacgggtccctcccggtccccgttacggtcccttacgttcccgttccggttccccccg

SEQ ID NO: 303412 - DNA, 794 bp, Homo sapiens
  misc_feature: GZ8MTXP01BV0T9.25.22.B11.1.454.CMB.2.raw
  modified_base (316)..(316): a, c, t, g, unknown or other
  misc_feature (316)..(316): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgtacttaataactatcgtctccgtggtaccccaaacaaccaccccaggaccaacggacccccaaactcactctatttangatgtcagtcacgtccgccctgtggtagtttctggttcgtctttcctcgtcggtcctaccgaagtccgtacggccaaaccgtccgggtcccttccccgtacgaaccctacgttccgtcccgggggtccttcccggaacgggtcgtacgggaaacgggaaccgggtaacgggttacctttaaacgtttaacgtttaacgtttacggtaacctttaaacgtttttacgaaaactttaaaccccggtaaaggtaaaccggaaacccctaaaccccgtaaaacgtaacgggtttcccggtttaggggtttacggggtttaccgggggaaaccggggtacgggggtaaaacccgttaacgggtttccgggtaaacccccggttccggttaccgggtacgacccgggttaccccgaaacggggtccctcccggtaaccccccgttcgggtacccttccgttccgtttccccggtttccccccgg

SEQ ID NO: 303413 - DNA, 544 bp, Homo sapiens
  misc_feature: GZ8MTXP01EVZ7P.25.22.B11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (333)..(333): a, c, t, g, unknown or other
  misc_feature (333)..(333): n is a, c, g, or t
  modified_base (448)..(448): a, c, t, g, unknown or other
  misc_feature (448)..(448): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacngtcgtcaccatcctcctgcactggaaccngccgtgactagttgggtnactttaataactntcgtctcctggtcccaaacaacacccaggcaacggccccaaatcatcatttatgatgtcagtcatcggccctgtggatttcnggtcgcttcctctggctcaagtctggcaactcgcctcctgaccatcgtcgggctcgaggctggaggacgaggtctacgttattacttgctatttcgattacagacgacaccaacngtacgtggtgttcggcgggaggaaccgtaagttcggaccgttcgtcggtcacgttcccaagggtcctcgcccctggtccactcgttccggttcccc

SEQ ID NO: 303414 - DNA, 619 bp, Homo sapiens
  misc_feature: GZ8MTXP01DEOV5.25.22.B11.1.454.CMB.2.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaccngccgtagactattggtntacttaataactntcgtctctcgtacccaacaacaccaggccaacggaccccaaatcatactatttangtatgtacagtcactccggcccttgtggtagtttctcggtcgtcttcctctcggtctcagtcgtcgcaacgtccggaccctcccgtcgacctacgtccggtccggggtctccggacggtctaggaacgggacgacggtcttaacgttattattagcttaatttacgaattaacgaagaacaacaaccgtaagtcgtacgtgggttcgttacggcgggaacgggtaactaaggttcgtacccgttccgtacggtcacggcccgaacggtcctaccgtcccccgtcggtaccttccgttccttcccgttaaccccc

SEQ ID NO: 303415 - DNA, 645 bp, Homo sapiens
  misc_feature: GZ8MTXP01AK000.25.22.B11.1.454.CMB.2.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtagactagtttgggtntactttaataacttattcgttcctccctacggtaccccaaacaaccaccccaggaccaacggaccccccaaactcactctaatttatgatgtacagtcatccggccctgtcggtagtttcgtggtcgtcttcctcgtggcctccgaagtcgtggccaacgtccggccttccctcgaccagtccgtcggggcctccgaggcgtggaggacgaggtcttacgttattattgtacttattacgacttaacgagaagaccaaccgaacgtacgttacgtagggttcggttaccggggacgggaacgggtaaccgtaaggtttccggaacccgttccgtaccggtcgaccgcccgaacggtcctcccggtcccccgttaggtcccttaccgttccgttcccggttcccccg

SEQ ID NO: 303416 - DNA, 551 bp, Homo sapiens
  misc_feature: GZ8MTXP01BLHLQ.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (531)..(531): a, c, t, g, unknown or other
  misc_feature (531)..(531): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtcctgggactcctggacagtcgtcaccatctcctgcactggaaccngccgtgacattggtncttaataactntgtctctgtccaacacaccagcaacgccccaatcatcatttangatgtcagtcatcggccctntggtagtttctggtcgtcttcctctgctccaagtctggcaactcgcctccctgaccntcgtcgggctcgagctgagacgagtcttactattatgactatttcgattacagacgacaacccaanagttccgtggtcggttcggacgggtacgggaaccgtaacggttcgaacccgtttcgtcggtcgaacgcccgttaagggccctcggccccttacggtccnccttaaccgttcgttccccc

SEQ ID NO: 303417 - DNA, 537 bp, Homo sapiens
  misc_feature: GZ8MTXP01A8KMC.25.22.B11.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (402)..(402): a, c, t, g, unknown or other
  misc_feature (402)..(402): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagactgtacagtcacgaccggtgctcgatttagacgacagctcagggggggtctcaggaggcagcgctctcgagacgtctccaccatggcctgggctctgctgttcctcaccctcctcactcagggcacagggtcctgggcccagtctgccctgactcagcctgcctccgtgtctgggactcctggacagtcggtcaccatctcctgccactggaaccagccgtgacattgggtncttataactntgtctctggtcccaacaacacccagcaaggccccaaatcatcatttatgatgtcagtcatcggccctctggtagtttcgtggtcgtccttctctggctccaaagtctggcaacgtcgccctccctgaccatcgtcgggctcgaggctgaggacgnggctacgttattattagctatttcatacagagacacaanagtctggtnttcgggcggtaagggacttagttcgaccgtctcggttcgacgcccgaaggctaaccgccccgtcggttacctaacgttcgtccccgg

SEQ ID NO: 303418 - DNA, 732 bp, Homo sapiens
  misc_feature: GZ8MTXP01BL2TG.25.22.B11.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaccngccgtgacnttggtntacttaataactntgtctcctcgtaccaacaacaccagacaacgaccccaactcatctatttatgatgtcagtctacgtccggtcccttgtggttacgtttcgtcggttccgtctttcccgttcgtcggtacctaccgtaacggttccgtacgggaacctaaccgtcccgggtccccttccccgtacgtaacccgtacgttcccgggtccggggtaccttccggacgggtccgtagggaacggggtaaccggtacggttaccttaacgttagttacgttcggtacttactttacgaacgttaacgaacggtaacgtaaccctaaacccgtaacgtacggttaccggttcggggttacgggttaccggggaccggggtaacgggtaaaccgttaaacgggttccggtaaccccggttccggtaccgggtaccgaccgggcccgaacgggtccctcccggtccccgttcggtccttacccgttccgttcccgttaacccc

SEQ ID NO: 303419 - DNA, 729 bp, Homo sapiens
  misc_feature: GZ8MTXP01BXLPB.25.22.B11.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgacattggtntacttaataactatcgtctcctcggtacccaacaaccacccaggaccaacggacccccaaactcatctatttangatgtcagtcacgtccggccctgtggtagtttctggtactctttcctcgtggtacctaccgaagttccgtacgggtcctaaaccgtcccgggtcccctccccttaggaacccctgttcccggtccggggtcctcccggaagggtcctagggaacgggtaccgtacggttacctttaacgttttaattacgttacggtacttaacgttttacgaaacttacgaagggtaacgtaaaccctaacccgaaacgttaggttaccggtggggttcggggttaccggggaccggggtaaacgggtaaccccgttaaggttcccggtacccggttccgtaccggtcgaacccggttcccgaacggtcccgttccccggtcccccgttacgggtcccttaccgtttcccgttcccgtttaacccccccg

SEQ ID NO: 303420 - DNA, 739 bp, Homo sapiens
  misc_feature: GZ8MTXP01BJTGM.25.22.B11.1.454.CMB.2.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaaccngccgtanactgttggtntacttaataactntcgtctccgtcgtacccaacaaccaccgaggaccaaccgaccccaaactcatactatttatagtatgtcacgtctacgtccgtcccttgtcggttacgtttcgtcggttccgtctttcccgtcgtcggtccttaccgtaacgttccgtacggtcctaaccgtcccggtccctcccgtacgacccgtacgtccggtccggggtcctaccggacgggtcgtacgggaacgggtaacggtacggttacctttaacgtttagttacgttcgtacttacgtttacgaacgttaacgaacgtaaccgtaaccctaacccgtaacgtacggttaccggttacgggttacggttaccggggaccgggtaacgggtaaaccgtaacgggtttaccgtaccccggttccgtacccgggtacgaccggttcccggttaacggtccccgtcccggtcccccgttaccggtcccgttacccgttccgttccccgtcccccg

SEQ ID NO: 303421 - DNA, 695 bp, Homo sapiens
  misc_feature: GZ8MTXP01BC7TM.25.22.B11.1.454.CMB.2.raw
  modified_base (222)..(222): a, c, t, g, unknown or other
  misc_feature (222)..(222): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatcctctgcacgtaggaaccngccgtagactagttgggtatactttaataactattcgtctccgtcggtacccaaacaaccaccgacggaccaaccggacccccaaaactcatactatttatgatcgtcagtcactccggtccctgtaggtacgtttcgtcggtcgtctttccctcgtcggtcctaccgtaacgtctcgggctaacccgtccgggtccctccccgtacgacctacgtccggtccggggtctccggaggtcgtaggacggtacggtacggtacctttaagtttacttagttcgtacttattcaaagtaactaacgacgaaccaaccgaaacgtggttcgttgggttacggttacgggtaccggaacggggtaacctttaagggttccggtaacccgtttccgtcggggttaaccacggcccgttaacggtcccgttcccgtcccccgttacgggtccttacccgttccgttcccggtttcccccg

SEQ ID NO: 303422 - DNA, 534 bp, Homo sapiens
  misc_feature: GZ8MTXP01BGK9U.25.22.B11.1.454.CMB.2.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
  modified_base (491)..(491): a, c, t, g, unknown or other
  misc_feature (491)..(491): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggctacagggtcctgggcccagtctgccctgactcagcctgcctcgtgtctgggactcctggacagtcggtcaccntctcctgcactggaaccngccgtgactattgggtntcttaataactatcgtctcctgtcccaacacaccagcaacgccccaatcatcatttangatgtcagtcatccggcccttcgtggtgtttctggtcgtcttcctcgtgctcagtctcggctacgtccgcctcctgaccntcgtcgggctcgaggctggagacgagtctattatntgctatttcgatacagacgaccacaacngtacgtggtcgtcggcgggacggtaactaaggttcgtaccgttcgtcgggcncgccgaggcctccgccccgtggtcttacctcgttccgttcccc

SEQ ID NO: 303423 - DNA, 549 bp, Homo sapiens
  misc_feature: GZ8MTXP01DXJ9S.25.22.B11.1.454.CMB.2.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
  modified_base (451)..(451): a, c, t, g, unknown or other
  misc_feature (451)..(451): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtntacttaataactattcgtctcctggtacccaacaacacccaggcaacggccccaaatcatcattatgatgtcagtcatcggccctntggtatttctggtcgtctttctctggctcccaagtctggcaacgtcggccctcctcgaccatccgtcggggtctccgaggctagacggacgtaggcttacttattattgactatttcattacagtanacaacacagtctgtggttacggcgaggaacctaagttcgaccgttcgcggtcacgcccaaggctccgccccgtcggtccactccgttccgttcccccg

SEQ ID NO: 303424 - DNA, 672 bp, Homo sapiens
  misc_feature: GZ8MTXP01CF3HJ.25.22.B11.1.454.CMB.2.raw
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctctgcactggaaccagccgtagactagttgggtatacttaataacttattcgtccttccgtcggtacccaaacaaccacccgagaccaacgaccccaaactcatactatttatgtatgtctagtcacgtccggtccctagttggtacgtttcgtggtcgtcttcccgtcgtcggtcctaccgtaagtccgtacgggcctaaaccgtcccggtcccctcccgtacggaaccctcgtcccgtccgggggtctccggaggcgtacggacggtaacgtacgtcttaacttagttaactgtacttactttacgtaactaacgaagtaaccgaacaaccgtaactacggttcgttcggtacgttcggggacggtacgggaacctaaggttcccgacgttccgtacggtccaccggccttacggtccgtacccgtcccccgttcggtaccttccgttccgttcccgttcccccg

SEQ ID NO: 303425 - DNA, 535 bp, Homo sapiens
  misc_feature: GZ8MTXP01AI47O.25.22.B11.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacagttggtgcttaataactntcgtctcctggtcccaacaacacccaggcaaggccccaaactcatcatttangntgtcagtcatcgccctctggtatttctggtcgtcttctctggctccagtctggcaactcggcctccngacatctcgggctccagctgagacgagcttactagttatgactattcatacanacgacacaacagtctggtgttccggnggtacggaacgtaagttgaccgttcgtacggtcacggttcccgaaggcctacggtccccctcgggtccttcgttccgcggtttcccccg

SEQ ID NO: 303426 - DNA, 671 bp, Homo sapiens
  misc_feature: GZ8MTXP01AMTN5.25.22.B11.1.454.CMB.2.raw
  modified_base (245)..(245): a, c, t, g, unknown or other
  misc_feature (245)..(245): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtgcttataactntcgtctctcgtaccaacaacaccagacaacgacccaactcatctatttatgtatgtctagtcacgtccgtcctcgtggtagtttcgtcggtcgtcttccgtcgtcggtctaccgtaacgtcgtacggctaccgtcccgtccctaccctacgtacctacgtccggtccggggtcctaccggacgggtcgtaggacggacggtacggtacgttaacttaacgtttacgttacgttacttactttacgtaacgtaacgtaacgaacgtaaccgaaccgtaacgtacgttacgttacggttcgggtacgggtacggggtaacgggtaaaccgtaacggttacggtaccggttccgtccggtccgaccgcccgttaccggtccgtcccgtccccgttcccgtccgttacccgttcccgttcccgttccccg

SEQ ID NO: 303427 - DNA, 617 bp, Homo sapiens
  misc_feature: GZ8MTXP01APLJ6.25.22.B11.1.454.CMB.2.raw
  modified_base (238)..(238): a, c, t, g, unknown or other
  misc_feature (238)..(238): n is a, c, g, or t
  modified_base (306)..(306): a, c, t, g, unknown or other
  misc_feature (306)..(306): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgactagttgggtntacttaataactattcgtctcctggtacccaacaacacccgagacaacgccccaaatcatctatttangatgtcagtcactccggtccctgttggtacgtttcgtggtcgtctttcccgtcgtacggtcctaccaagttccgtcgcctaaaccgtccgggacccttcccgtacgaccctagtcccggtcggggcctacggacggccgtggacggacgaggtactactttattattcacttattcataacgtagaactacaccgaagtaggtctacggtggtcggacgggagggaactaacggttcgtacccgttcgtcgtcgacgcccgaggtccgtccgtaaccccgtcggtccgttaccttccgttcccgttccccg

SEQ ID NO: 303428 - DNA, 555 bp, Homo sapiens
  misc_feature: GZ8MTXP01ETGXY.25.22.B11.1.454.CMB.2.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (436)..(436): a, c, t, g, unknown or other
  misc_feature (436)..(436): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcttgggttttccttgttgctcttgtaaaaggtgtccattgtcaggtgcagttggtgcagtcgtgggggagcttcgtcaagccgtggagggtccctgagactctcctgtgagtctctggattcaccatcaatgacttacttanggctggatccgcaggctcgagggagggctggagtggatttcattancagtatggagtaatggactatttaanatccagactcgtcggagggcccgcttcacctatctccgagggaaccaaccggaccaacaactacaacttctttcncggactaagtacgaacgacgtccgagccgaggacgacggcgtgtactcgtgttggcggttaggtggttgggggttattagttgaatgcgtagtggttactaacccgttaacccgttaac

SEQ ID NO: 303429 - DNA, 742 bp, Homo sapiens
  misc_feature: GZ8MTXP01EYZG4.25.22.B11.1.454.CMB.2.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactattggntcttaanaactntgtctctgtaccaacaacaccagcaacgaccccaaatcatcatttangatgtcagtcatccggcccttagtcggtagtttctggtctcttccctcgtacggtcttaccgaagtccgttgggcctaaaccgttcccgggtccccttccccgttacggaacccctacgttcccggttccggggggccttaacccggaggggttcccgtaagggtaacggggaaaccgggtacggggttaccctttaaacggttttaactttaaactttggtaccctttaagtttttaccgaaatttaaaccgaaggaaacgtaaaccaaacccctaaacgtaagttaccggtgggtttacgggttacccggggagggtaaacggggaaacccgttaaggtttaaccggacccggtttcccgtacggggtaccaaccggttcccgaaagggtcccctaccggtccccccgttcgggtcccaccctttcccgttccggtttcccccccg

SEQ ID NO: 303430 - DNA, 651 bp, Homo sapiens
  misc_feature: GZ8MTXP01B6AVZ.25.22.B11.1.454.CMB.2.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacntctctgcactggaaccngccgtgactnttggtntacttaataactatgtctcctgtacccaacaacacccaggcaacgaccccaaatcatctatttatgatgtcagtcatccgtccctgtggtagtttcgtggtctctttcctctcgtctcagtctggccacgtccggccctccctcgacctacgtccgtcggggtcctccggaggcgtaggacgggacgtacggtcttaacgttagttattcgtacttactttacgaacttacgtaacgaacgaccaaccgtaaacgtacgttccggtagggttcgggttacgggaccgggtaacgggtaaccgtaaggtttccggacccggttccgtaccgggttcgaacccggccccgttaacgggtcccctccccggtcccccgttcggtacccttacccgttcccgttccccgggtttccccccg

SEQ ID NO: 303431 - DNA, 552 bp, Homo sapiens
  misc_feature: GZ8MTXP01AOLV1.25.22.B11.1.454.CMB.2.raw
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtnctttaataactatgtctcctcgtacccaacaacacccagcaacggccccaaactcatctatttangatgtcagtcagtccggcccttcgtggtagtttcgtggtcgtctttcctctggcctccaagtcctggccaacgtccggccctccctgaccngtccgtcgggctccgaggcgtggaggacgagtcttacttattattgctatttcgatacagagaccacatagtcgtggtgtcggacggaggtaacctaggttcgaccgttcgtcggtcacgccaggcctcgcccctcggtccacttccgttccgttcccc

SEQ ID NO: 303432 - DNA, 617 bp, Homo sapiens
  misc_feature: GZ8MTXP01DHYJF.25.22.B11.1.454.CMB.2.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
tcagactgtacagtcacgaccggtgctcgatttagacgacagctcagggggagctctgggagaagagccccagccccagagttcccaggagtttccattcggtgatcagcactgaacacagaggactcaccatggagtttgggctgagcttggggttttccttgttgcttcttagtaaaaggtgtccattgtcaggtgcagttggtgcagtcgtgggggagcttcgtcaagcctggaggtccctgagactctctgtgaagtctctggattcaccatcaatgaacttactttanggctggactccgcaggctaccgaggggacgggctgggtagtgggtatttctatttatacgtaagtaagtagggtaaggtaatgggtactaatttaataaactcaagtactcgtaccgggaggggcccncttcaacctatcctaccgaaggaaccacggaccaacaactctaacttcttctagggactaaggtacgaacgacgtccgacgaccgaacggcacgggtcctagtacgttctggcgtaggagttagggtttgggggttaatttgagtaacgtcggtccgttaggttcggtttaaaccctcccttaaccccgtttaacg

SEQ ID NO: 303433 - DNA, 583 bp, Homo sapiens
  misc_feature: GZ8MTXP01AO348.25.22.B11.1.454.CMB.2.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtgcttaataacgtntgtctctgtccaacaacaccagcaacgcccaatcatcatttatgatgtcagtcagtccggccctcgtggtagtttcgtggtcgtctttcctctggctccaagtctgggccaaccgtcggcccttacccgtcgaccgatccgtccggggctccgaggccgtaggacggacgaacgggtcttaacgtttagttattacggcttactttcggaattaacgagaacgaaccaaccaaccgaggttccgtgggtcgttcgggcggtagggaacctaaggttcgaccgttccgtcggtcacgccgacgcctcgccccgtggccttcgtccgttcgttccccg

SEQ ID NO: 303434 - DNA, 767 bp, Homo sapiens
  misc_feature: GZ8MTXP01BWD6C.25.22.B11.1.454.CMB.2.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaacccngccgtgactagttggtnctttaataactntgtctcctggtcccaacaacacccagcaaggcccccaaactcatcatttatgatgtcagtcatcggccctatggtacgtttctggtcgtcctttcctcgtcggtctaccctaagttccgtagggcctaaaccgtccgggtccccttaccccctcggaccctacgttcccggtcccgggggtccttacccgaggggtccgttacggggacgggaaccggtaggggtacctttaaccggtttatttacgtttacggtcttaactttttacaaacgtttaaacgaacgacggtaaacccaaacccgaaaaccgttaggttaaccgtttcggggttcgggttacccggggtaccggggtaacgggggtaaacccgttaaacggggttttacggaaaccccggtttccccgggttaccgggttacccgttaccggccccggaaacgggttcccggtaccccgtcccccggttaacccgggtccttaaccccgtttccgttccccggttttaaccccccc

SEQ ID NO: 303435 - DNA, 615 bp, Homo sapiens
  misc_feature: GZ8MTXP01D5WU3.25.22.B11.1.454.CMB.2.raw
  modified_base (238)..(238): a, c, t, g, unknown or other
  misc_feature (238)..(238): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgtcctgactcagcctgcctccgtgtctgggactcctggacagtcggtcaccatctcctgcactggaaccagccgtgactattgggtntacttaataactatgtctcctgtacccaacaacaccaggcaacgaccccaaactcatcatttatgatgtcagtcactcggccctcgtggtagtttcgtggtcgtcttcctcgtcggtctaccgtaagtccgtggcctaacgtccgggtccctccctacgacctagtccgtcggggcctccgaggcgtggaggacgtacggtacttacttattattgtcttatttacaattacgaagaacgaaccaaccaagtcggttacgttgggttcggttacgggcgggtaacggtaacctaacggttcgacccgttccgtcggtccacggttccgaacggtccgtcccgtccccgtcggtccttaccttccgttccgttccccc

SEQ ID NO: 303436 - DNA, 529 bp, Homo sapiens
  misc_feature: GZ8MTXP01A27SR.25.22.B11.1.454.CMB.2.raw
  modified_base (192)..(192): a, c, t, g, unknown or other
  misc_feature (192)..(192): n is a, c, g, or t
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggaaccagccgtgacattggtnactttataactattgtctcctggtcccaacaacaccaggcaacgccccaaatcatcatttatgatgtcagtcatccggccctntggtatttctggtcgcttctctgctcagtcngcactcgcctcctgacntcgtcgggctccgaagctgagacgngctacttattatgctatttcatanatagacacaangtactggtgttcgggcggtaagggcctaaggttcgaccgttccgtcgtcgacgccacggccttccgcccccgttcgggtaccttccttccgttccgttccccc

SEQ ID NO: 303437 - DNA, 531 bp, Homo sapiens
  misc_feature: GZ8MTXP01A7PJJ.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttaataactntgtctcctggtacccaacaacaccaggcaacggccccaaatcatctatttangatgtcagtcatcggccctcgtggtatttctggtcgtcttcctcgtggctaccagtctggcaacgtccggcctccctgactactcgtcgggctccgaggctagacggacgagtctacttatatgctatttcatacagacgacacanagtcgtggtgtcggcggnggaactaagttcgaccgttcgtacggtcacgccaaggcctcgcccctggtcacgtcgttcgttcccc

SEQ ID NO: 303438 - DNA, 652 bp, Homo sapiens
  misc_feature: GZ8MTXP01DVKPO.25.22.B11.1.454.CMB.2.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccntctcctgcactggaaccngccgtgactagttggtntacttaataactntcgtctcctcggtacccaaacaacaccaggaccaacggaccccaactcatctatttatgtatgtcagtcagtcggcccttagtggtagtttcgtggtcgtctttcctcgtggtccttaccgaagttccgttcgggcctaaaccgttcccgggtaccccttccctacggaccctacgttcccgtccggggtctccgagggtccgtggacgggaacgtaggtacttaacttattacttgtacttactttacgaattaacgaggaacaacaccctaaagtcgttacgtgggttcggttacggggcgggtaagggaacctaaggttccggaccgttccgtacggtccacggttcccgaacggtcctccgtccccgtcggtccttaccgttccgttcccgttccccg

SEQ ID NO: 303439 - DNA, 682 bp, Homo sapiens
  misc_feature: GZ8MTXP01BV5E5.25.22.B11.1.454.CMB.2.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcacctatctcctgcactggaaccngccgtanactagttggtntacttaatactntcgtctccgtcgaccaacaacaccgacgaccaaccgacccaatcactactatttatgtatgtacagtctacgtccgtcctcgtggtacgtttcgtcgtctcttccgtcgtgtacctacgtagtcgtacgcctaccgtccgtccctacctacgacctacgtccggtccgggtcctacggacggtacgtaggaacggtacggtacgtacttacttagttactacgtacttacttacggtaactaacgaacgtaaccgaaacctaaccgtaacgtacggtttaccggtcgggttacgggtaccgggtacgggtaacggtaaccgttaaacggttcccggtaacccggttccggtaccggtaccgaaccggcccggttaacggtcccgtcccgtccccgttccgtcccttaccgttcccgttcccgttaaccccg

SEQ ID NO: 303440 - DNA, 846 bp, Homo sapiens
  misc_feature: GZ8MTXP01CMYM4.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
tcagactgtacagtcacgaccggtgctcgatttagacgacagctcaggggggggtctcaggaggcagcgctctcgggacgtctccaccatggcctgggctctgctgttcctcaccctccttactcagggcacagggtcctgggcccagtctgccctgactcagcctgcctccgtgtctgggactcctggacagtcggtcaccatctcctgcactggaaccngccgtgactagttggtntctttaataactatcgtcctcctcggtacccaaacaacacccaggaccaacggacccccaaactcatactatttatgatgtcagtcatccggtccctcgttggtacgttttcgtcggttccgtcctttccgttcccgtcgggtaccttacccgtaaacgttccgtaaccgggtaccctaacccgttcccgggtacccccttcccgtaccggaaccctacgttcccgggtcccgggggtcccttccggaacgggtccgttacgggaacggggtaaccggtaacgggttacctttaaacgttttaagtttaacttcgtaacttaacttttacccgaaattaaccgtaaacgggtaaacgtaaacccaaacccgtaaaccgttaacggtttccggtttaacgggggtttcggggtttaccgggggaccgggggtaaaccggggttaaccggtaaaacgggttttcccgggaaccccggtttcccgttacggggttaacccgaccgggttaaccccggaaacggggttccccgttaaccccgggtcccccccgttaaccgggttcccttacccgttcccggtttaaccccgtttcccccccgttaacccccg

SEQ ID NO: 303441 - DNA, 599 bp, Homo sapiens
  misc_feature: GZ8MTXP01AX8MN.25.22.B11.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacnttggtncttatactntgtctctggtcccaacaacacccaggcaacggccccaaatcatctatttangatgtcagtcatccggccctcgttggtagtttcgtggttcgtctttcctccgtcggcttacccgtaaagtccgtcgggaacctaaccgtcccgggtccctccccgtagtaccctacgttccgtccggggctccgaggtcgtaggaggacgaggtctacgttattatgactatttcatacagacacaacacgtagtcgtggtcggttcgggacgggaacggtaactaaaggttcgtacccgttccgtcggtcacggttcccgaggcctccggccccttcgggtccaccttccgttcgtcccccg

SEQ ID NO: 303442 - DNA, 594 bp, Homo sapiens
  misc_feature: GZ8MTXP01EZAW5.25.22.B11.1.454.CMB.2.raw
  modified_base (237)..(237): a, c, t, g, unknown or other
  misc_feature (237)..(237): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttggtncttaataactatcgtctcctggtacccaacaacaccagcaacgaccccaatcatctatttatgatgtcagtcatccggccctgtgtagtttctggtcgtctttcctcgtgctaccgaagtctcgctaactccggccctccctcgacctactccgtccggggactccgaggcgtaggaggtacgagtcttacgttattagttcgactatttacgatacgaagacgaacaccaacgtgtcgtagggtgttaccgggacggacgggtaactaggttacgacccgttccgtacgtacgaccgcccgttaacggtcctcccggtccccctcggtccttaccttcccgttccgttaacccccc

SEQ ID NO: 303443 - DNA, 539 bp, Homo sapiens
  misc_feature: GZ8MTXP01A62U2.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtntacttaataactatcgtctcctcggtacccaacaacacccaggccaacggcccccaaactcatctatttangatgtcagtcactcggccctatggtagtttcgtggtcgtctttcctctgctcagtctggcacgtccgccctcccngacctagtccgtccgggctccgaggcgtagaggacggagtacttactttattattgcttattcgatacagacgaacacaangtctggtcgtcggnggacggaactgttcgcgttcgtcggcncgccagcctcgccctgcactccgttcgtccccg

SEQ ID NO: 303444 - DNA, 619 bp, Homo sapiens
  misc_feature: GZ8MTXP01EJEEL.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattgggtncttaataactntgtctcctgtccaacaacaccagcaacgccccaaancatcatttatgactgtcagtcatccggccctgtggtagtttctggtcgtcttcctcgtggctcaagtctcggcactcggcctccctgaccatcgtcgggctccgaggctggaggacgaggtacttaacttattatgtactatttacaattaacgagtaacaacaacccaacgtaacgttccgtgggttacggttacgggacgggtaacgggtaaccgtaaacggttcggaaaccccgttccgtacggtacccgaacggccccgttaaacggggtccctcccgggtccccccgttacgggtacccttaccggttccttaacccggtttccccccc

SEQ ID NO: 303445 - DNA, 667 bp, Homo sapiens
  misc_feature: GZ8MTXP01AMC6N.25.22.B11.1.454.CMB.2.raw
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggaggtccctgagactctcctgtgagtctctggattcaccatcaatgacttacttancgctggactccgcaggctcgaggggagggctgggagtggtatttctatttatcgtagtaagtggagtaatggaactaatttaanaaactccgtaagacctccgtccgggaggggtcccncgtttacaccctagtcctaccgaaggggaaccaacgggcccaaacaacttacctaaactttcctttacgcggtaactaaaggttacgaaacccgtacccggtccggaacgacccggaacggacccgtcccgggttaccgttacgttaaccgttccgttaggttcgggtacggaagggttacggggtttagggggtttacttaggttgtaacgttcgaaccgttacggttcggtttaacctaacccccgttaaccctttaacg

SEQ ID NO: 303446 - DNA, 780 bp, Homo sapiens
  misc_feature: GZ8MTXP01B5FJW.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattgggtncttaataactatcgtctcctggtcccaacaacaccaggcaacggccccaatcatctatttangatgtcagtcatccgcctgtggtatttcgtggtcgtctttcctcgtaggccttaccgaagttccgtacggcctaaacccgtcccgggtcccttccccgtagaccccgtacgttcccggtccgggggtccttacccggacgggccgttacgggaacggggtaaccggtacgggttacctttaaccggtttaaatttcgttacggtactttaacgttttaccggaaactttaacccgtaaggtaaaccggaacctaaaccccgtaaacgttaacggtttccgttaggggttacggtttccggggaaccggggtaacggggtaaacccgtaaacgggtttccgggtaaaccccggttcccgttaccggggttaaccgacccgggttaaccccgttaaacggggttccccgtttcccgggcccccccgtttaacgggggtcccttaaccccgggtttccgtttcccccggttttaacccccccg

SEQ ID NO: 303447 - DNA, 681 bp, Homo sapiens
  misc_feature: GZ8MTXP01CC5F4.25.22.B11.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgaactnttgggtntacttaataactntcgtctcctcgtacccaacaaccaccgagaccaacggaccccaaatcactctagtttatgatgtcagtctacgtccggcccttgtggtacgtttcgtggtcgtctttcctcgtcggtctaccgtaagtccgttacggcctaaccgtccgggtccctccgtacgtaacctcgtccgtccggggtctacccgggtaggtacgtaggacggtacggtacgttacttaacttagttacgttactacttactttacgaactaacgaacgaactaacctaaccgtaacgtcggttcggtcgggttcggtacgggacgggtaacggtaaccgtaacggttaccggtcccgttaccgtccggtaccgaccggttacccgaccggtccccgtcccggtccccgtcggtcccgttaccgttcccgttcccggttcccccg

SEQ ID NO: 303448 - DNA, 507 bp, Homo sapiens
  misc_feature: GZ8MTXP01ARVEY.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
  modified_base (401)..(402): a, c, t, g, unknown or other
  misc_feature (401)..(402): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttaanaactntgtctctgtcccaanaacacccaggcaacggccccaaatcatcatttangatgtcagtcatcggccctntggatttcngtcgcttctctgctccaagtctggcaactcggcctcctgaccatctcgggctccgagctgagacgngctatatatnntatnananananacacacagtgtgtgtcggcggaggaacgtacgttcgtcgttcgtcgtcgacgccgacgcgtccgtcccgtccgtcgttctccgttccgtcccg

SEQ ID NO: 303449 - DNA, 556 bp, Homo sapiens
  misc_feature: GZ8MTXP01AQ9C8.25.22.B11.1.454.CMB.2.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccntctctgcactggaaccngccgtgactattgggtntctttaataactntgtctcctcggtacccaacaacacccaggaccaacggacccccaaatcatctatttatgtatgtcagtcatccggtccctgttggtagtttctggtcgtcttcctctggctccagtctggccacgtccggccctccctgacctatccgtcgggctcgaggctaggaggacgaggtcttacttattatgtactatttacgattacgagacgtacaaccaagtgtcgtggtcggttcggacggacggaactaagttcgaccgttcgtcggtcacgccaggcctcgccccgtggtccacttcgttcgttcc

SEQ ID NO: 303450 - DNA, 535 bp, Homo sapiens
  misc_feature: GZ8MTXP01B8LO2.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactntgtctcctgtcccaacacacccaggcaacggccccaaatcatcatttangatgtcagtcactcgccctntggtatttctggtctcttcctctggctcctagtctggcactcggccctcctgaccntccgtcgggctcgaggctgaggacgagtcttacttattattgctatttcgattacagacgaccacgaactagttcgtgggttgtcgggcggtacgggaactaggttcgaccgttcgtcggtcacgccgaaggctccgcccgtcgtcaccttccttcgttccccg

SEQ ID NO: 303451 - DNA, 579 bp, Homo sapiens
  misc_feature: GZ8MTXP01B5UVY.25.22.B11.1.454.CMB.2.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacgagggtcctgggcccagtctgccctgactcagcctgcctccgtgtctgggactcctggacngtcgtcaccntctctgcactggaaccngccgtgactagttggtntacttaataactattcgtctcctggtacccaaacaacacccaggccaacgaccccaaatcatcatttangatgtcagtcatcggccctgtggtagttctgtctcttctctgctcagtctgcactcgcctccngaccngtcgtcgggctccgaggctggaggacgacggtcttacgttattatgtactatttacgaataacgagacaaccaaccgtaacgtacgttacgtggtcggttaccgggacgggaacgggtaaccgtaaaggttccggaccgttccgtacggtcacgcccgaacggcctcccgccccgtacggtccttccgtccgttccgttccccc

SEQ ID NO: 303452 - DNA, 636 bp, Homo sapiens
  misc_feature: GZ8MTXP01B8YAV.25.22.B11.1.454.CMB.2.raw
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcttgggttttccttgttgctcttgtaaaaggtgtccattgtcaggtgctagttggtgcaggtcgtgggggagtcttcgtcaagccgtggacggtcctgagactctctgtnagtctntgatcacatacaatgactactttncggctggactccgcnggctcgagggggagggctggagtggtatttcatttatcgtaagtaagtggtaagtaatggtaacttaatttaataactcccaagtacctccggtaccgggacggggaccctccgttaccaccgtactcctaccgaagggaacccgaaacggccaaacaacttaccaaaccttcttctaggactaaggtacgaaccgtaccggtccgacgccggaacgccgtaaccggtccgttcgttacgttcgtggttcgacggttagggttagggtttagggggttattggttgtaagtcgtaaccgtagttcggttactaaccccttaacccgtttaaccg

SEQ ID NO: 303453 - DNA, 633 bp, Homo sapiens
  misc_feature: GZ8MTXP01DK1TZ.25.22.B11.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccngccgtagactagttggtntcttaataactnttcgtctcctcggtacccaacaacacccaggacaacggacccccaaatcatcatttantatgtcagtcatcgccctntggtnttctgtcgtcttctctgctccagtctgcactcgcctcctgactatcgtcgggctcgagcgtgaggacgaggtacttattattattgtacttatttacaacttacgaagtacgaacaaccctaacgtagttaccggttgggtcgggttacgggacgggaacgggggtaaacctaagggttaccggtacccggttccgtaccggggttccgaaaccgggttccccgttaaacggggtcccctcccgggtaacccccgttcggggtacccttccgtttcccgttcccggttttcccccccg

SEQ ID NO: 303454 - DNA, 879 bp, Homo sapiens
  misc_feature: GZ8MTXP01AT4VL.25.22.B11.1.454.CMB.2.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagactgtacagtcacgaccggtgctcgatttagacgacagctcgagggggggggtctcaggaggcagcgctctcgggacgtctccaccatggcctgggctctgctgttcctcaccctcctcactcagggcacgagggtcctgggcccagtctgccctgactcagcctagcctccgtgtcgtgggacctccgtggacaggtccggtcaccattcctcctgccacgtacgggaaccaggccgtagactagttggtntacttaataactntcgtctcctcggtacccaacaaccacccgaggaccaaccggacccccaaactcatactatttatagatgtacagtcacgtccggacccttcgtggtacgtttcgtcggttcgtcctttcccgtcgtcggccttacgtagttcccgtcggtaaccctaaccggtcccgtaccccgttcccccgtacgtaccccgtacgttcccgggtcccggggtcctacccggacgggtcccgttaggggacggaacgggtacggttacctttaaacgtttacgtttacgttaccggttactttaaacgttttactaaacgtttaaaccggtaaacggtaaacccggaaaccctaaaaccccggtaaacgttaaaccggtttccggggttacggggtttaccgggggttttaacccgggggaaccggggtaaacgggggtaaaccccggttaaacgggtttcccgggtaaaccccggttccccgggttaccgggtaaacccgttaccccggggaccccgttaaaccggggtcccccggtttaacccccgggtcccccccggtttacgggttaaccccggttaccccttttccccgggttcccgttttaaccccccccccg

SEQ ID NO: 303455 - DNA, 647 bp, Homo sapiens
  misc_feature: GZ8MTXP01B1Y6Z.25.22.B11.1.454.CMB.2.raw
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttggtgtctttaataacttatcgtctcctcggtacccaaacaacacccaggaccaacggacccccaaactcatactatttatgtatgctagtcagtccggcccttgtggtactttcgtcggtcgtcttccgtctcggtctaccgagttctcggcctaaccgtcccgcccttcccgtacgacctacgtccgtccggggcctccgaggctaggacggtaacgaggtacttacgtttattattcgtntaactttnaacttacgaagacgaaaccaccaacgtacgttccgttggtcgggttacggacgggacggtaacgtaacggttcggtacccgttaccgttcgggtacaccggccgacggtaacccgtccccggaaccccgtccggtccttaccgttccgtttaacccgttccccc

SEQ ID NO: 303456 - DNA, 604 bp, Homo sapiens
  misc_feature: GZ8MTXP01A95YF.25.22.B11.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacattggncttataactatcgtctcctgtcccaacaacacccaggcaacggccccaaactcatctatttangatgcagtcactcggccctgtggatttcnggtcgtcttcctctggctcagtctggctaacgtcggtccctcctacgaccactcgtccggggtctccgacggcaggacggaccgtaggcttaactttattattacgtcttaatttcgaattaacaagactaacaacccaataagtccgtgggtcggttacgggacgggaaggggaaccgtaacgggttcgtaacccggttccgttcggtccacggccccgttaaacggtcccgtccgtcccccgtacggtccgttacctcccttccgggttccccccg

SEQ ID NO: 303457 - DNA, 722 bp, Homo sapiens
  misc_feature: GZ8MTXP01BHJ15.25.22.B11.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaccngccgtgactagttgggtntcttaataactntcgtctcctcgtacccaaacaacacccagaccaacggaccccaaactcatctatttatgatgtcagtcacgtccggccctgtggtacgtttcgtcggtcgtctttcctcgtcggtcctaccgtaacgtccgtacgggcctaaaccgtcccgggtcccttcccgtcgaccctagtcccggtccgggggccttaccggacgggtcgtagggacgggtacggtacggtactttaactttattacgttactacttaacgtttcgtaaacttacgaacggtaactaacccaaaccgtaacgtaacggttcccgttaaggggttccgggttccgggacggggtaaccgggtaacccggtaaagggtttcccggaacccggtttcccgtaccgggttcgacccggttccccgaacgggttcccctacccggtccccccgttcggtacccttacccgttccgtttccccgttaaccccccg

SEQ ID NO: 303458 - DNA, 600 bp, Homo sapiens
  misc_feature: GZ8MTXP01A9SYT.25.22.B11.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtccggtctcctggacagtcagtcaccatctcctgcactggaaccagaagtgatcttggtncttangactntgtctcgtgcactagttaccagaaacncccagactcattccttangatgtcgaggaacgcgcccgtgacggtcctgactcgtcttctcccgtaggtacaagtcgtacgaacctaaaccgccggtccctacccgtacgacctcgtcgtcgtcgggcctcgagcgtagagngtgagtntagtattatgtgtactggttactagtgtgacgtacgcttaaacgttacgtttgtttcggtcgttcggcggtaacggtaacgggttccgtaaaggtttcgaaccggttcggttacggttcccaaaccggtcccgtacggtccgttccccggtcccccgttagttccccgttcctttccccg

SEQ ID NO: 303459 - DNA, 809 bp, Homo sapiens
  misc_feature: GZ8MTXP01CD7TC.25.22.B11.1.454.CMB.2.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcacgtaggaaccngccgtgactagttgggtntacttaataactattcgtctcctcggtacccaacaacacccagcaacgaccccaatcatctatttatgatgtcaagtcacgtccggtcctcgtggtacgtttcgtggtcgtctttccctcgtcggcctaccgtaacgtccgtacggtcctaacgtcccgggcccttcccctagtaccctacgtccggtccggggtcctacccggtagggtctacgggacgggacggtaacgggttccttaacgtttaacgtttacgttacggttactttaactttaccgggtaaacttaacccggtaagggaaaccctaacccgtaaacccgtaaccggtaacggtttcccgggtttagggggttaccgggttttaccgggggaacggggttaacccggggtaaacccggttaaacggggttttccggtaaaccccgggtttccggttaccgggggtacccgttaaccccgggggttaccccggttaaacggggtccccgttaaccccggggttccccccgttccggggttaaccccttacccggtttccccggtttcccccggttttaaccccccccg

SEQ ID NO: 303460 - DNA, 707 bp, Homo sapiens
  misc_feature: GZ8MTXP01ATYKV.25.22.B11.1.454.CMB.2.raw
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcagggggggggtctcaggaggcagcgctctcgggacgtctccaccatggcctgggctctgctgttaaaacctcaccctcctcactcagggcacagggtcctgggcccagtctgccctgactcagcctgcctccgtgtctgggactccgtggacagtcggtcaccatctctgcacgtgaaccngccgtgactagttggtgtacttataactatcgtctccgtcgtacccaacaaccacccaggaccaacgccccaaactcatctatttangtatntcagtcactccggtcctgtggtactttcgtgtctcttcctcgtgcctacgtagtctcgccacgtcccggtcctcccgtgacctacgttccgtccggggtcctccggaggtccgtacggaacgggtaaccggtacgttaccttaacgtttaacgtttacttcggtacctttacgtttacgtaacttaaaccgaacgaaaccgaacctaaacccgtaacgttacggttcggttacgggttcgggttaccggggaaccgggtaacgggtaaccgtaaacggttccggtaacccgttccggtaaccgggtcgacccggttaccggttaaccggtcccgttcccggtcccccgttacggtcccttacccgttccggttccccgttaaccccccg

SEQ ID NO: 303461 - DNA, 535 bp, Homo sapiens
  misc_feature: GZ8MTXP01A0GFH.25.22.B11.1.454.CMB.2.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgtcctgactcagcctgcctccgtgtctgggactcctggacagtcggtcatcatctcctgcactggaaccagccgtgacattggtncttataactatgtctctggtcccaacaacacccaggcaaggcccccaaactcatcatttangatgtcagtcatcggccctcgtggtgtttcnggtcnccttctntggctcaagtctgcactcgcctccngaccntctcgggctcaggctgacgggacgngctacttattgtntcatttcgaatacagacgcacatagtctggtggttcggcgggaaggaccaggttcgaccgttccgtacggttccgacggccccgaaggtccgtccgtcccccgtcgggttctaacccgttcgttccc

SEQ ID NO: 303462 - DNA, 594 bp, Homo sapiens
  misc_feature: GZ8MTXP01B3EGO.25.22.B11.1.454.CMB.2.raw
  modified_base (321)..(321): a, c, t, g, unknown or other
  misc_feature (321)..(321): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctcgtgtctgggactccgtggacaggtcgtcaccatctcctgcactggaaccagccgtgactagtttgggtgtactttaataacttatcgtactcccgtcggtaccccaaacaacacccaggaccaaccggacccccaaatcatctatttangtatgtcagtcacgtccggcccttgtggttattcgtcggtctcttcncgtgctccagtcnggcacgtccgcctccngaccntcgtcgggctcgngctggacgacgagtcttattattattgactagttacatacgaacgacgtaccactaacgcgttacgtggggtcgtcgggcgggaacggaaccgtacgttcgtcccgttcgtccgggtacaccgcgttaccgtccgtcccggccccgttcgtacccttacttccgttcccgttaaccccc

SEQ ID NO: 303463 - DNA, 717 bp, Homo sapiens
  misc_feature: GZ8MTXP01CNDKB.25.22.B11.1.454.CMB.2.raw
  modified_base (304)..(304): a, c, t, g, unknown or other
  misc_feature (304)..(304): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcgtcacatctctgcacgtggaaccagccgtgactagttggtgtactttaataacttatcgtctccgtcgtacccaacaacaccaggaccaacgaccccaatcatctattangtatgtacagtcacgtccgtccctgtggttacgtttcgtcggtcgttcttcccttcgtacggtcctaccgtaaagttccgtacggtcctaaaccgttcccgggaccccttaccccgtacgaaccccgtacgttcccgggtcccggggtaccttacccggagggtcgtacggggaacggaacggttaacggtactttaaacgtttattaattcgacttaacgttttacgaaacttaacgaacgaaacaaacctaaacctaaaccgtggttacccgtgggttcggttaccggggacgggtaacgggtaaccgttaaacggttcggtacccgttcgttaccggaccttaccggcccgttaacgggtccctcccgtcccccgtcggtccttaccgttcccgttcccggtttcccccc

SEQ ID NO: 303464 - DNA, 679 bp, Homo sapiens
  misc_feature: GZ8MTXP01BDUNU.25.22.B11.1.454.CMB.2.raw
  modified_base (196)..(196): a, c, t, g, unknown or other
  misc_feature (196)..(196): n is a, c, g, or t
  modified_base (321)..(322): a, c, t, g, unknown or other
  misc_feature (321)..(322): n is a, c, g, or t
  modified_base (325)..(325): a, c, t, g, unknown or other
  misc_feature (325)..(325): n is a, c, g, or t
tcagactgtacagtcacgaccggtgctcgatttagacgacagctcgagggggggggtctcaggaggcagcgctctcgggacgtctccaccatggcctgggctctgctgttcctcaccctcctcactcagggcacgagggtcctgggcccagtctgccctgactcagcctgcctccgtgtctgggactccgtggacngtcgtcaccatctctgcacgtggaaccagccgtagactagttggtatactttaataacttatcgtctcctcggtacccaaacaaccacccgaggaccaaccggacccccaaactcatctatttannatntacatcacgtcgccctgtggtagtttcgtgtctcttcctacgtcggctccagttcctcgctaaccgtccggcccttcctcgtacctatccgtcgggtctccgaggctaggacggacgtacggtacttaacgtttattagttctacttactttacgaacttaacgaagaaccgaaccaaacctaacgtacgttacggttgggttccgggtttacgggaccgggtaaacggtaaccgtaaacggtttccggtaaacccgttccggtaccggtaccgaaccggacccgaaccggttcccgtcccgtccccccggtttacggcccttacccgttccgttcccccggtttaaccccccc

SEQ ID NO: 303465 - DNA, 567 bp, Homo sapiens
  misc_feature: GZ8MTXP01ELFA3.25.22.B11.1.454.CMB.2.raw
  modified_base (239)..(239): a, c, t, g, unknown or other
  misc_feature (239)..(239): n is a, c, g, or t
  modified_base (307)..(307): a, c, t, g, unknown or other
  misc_feature (307)..(307): n is a, c, g, or t
  modified_base (461)..(461): a, c, t, g, unknown or other
  misc_feature (461)..(461): n is a, c, g, or t
tcagactgtacagtcacgaccggtgctcgatttagacgacagctcgagggggggggtctcaggaggcagcgctctcgggactctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattgggtnctttaataactattgtctcctggtacccaaacaacacccaggcaacggacccccaaatcatcatttangatgtcagtcatcggccctgtggtatttcgtggtcgtctttcctcgtaggctaccaagtctcgggctaacgtccggccctccctagaccagtccgtcggggcctcgaggctggacggacgaggtcttacttattactgactatttcatacaganacacacagtcgtggtgtcggcggaggaacctaaggttcgaccgttcgtcgtcacgttccgaacggtcctcccggccccttacggtccacgttccgttcgttccccc

SEQ ID NO: 303466 - DNA, 724 bp, Homo sapiens
  misc_feature: GZ8MTXP01EUR8M.25.22.B11.1.454.CMB.2.raw
  modified_base (236)..(236): a, c, t, g, unknown or other
  misc_feature (236)..(236): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatctcctgcactggaaccagccgtgactattggtntcttaataactatgtctcctcgtacccaaacaacacccgagaccaacggaccccaaactcatctatttatgtatgtactagtacacgtccggtacccttcgttggtacgttttccgtcggttccgtctttccccgtcggttcggtccttacccgtaacgttcgtaccgggtccctaaacccgtcccgggtaccccttccccgtacgtacccgtacgttcccgggtcccggggtcttacccggagggtccgtacgggaacgggtaaccggacggttaccttaacgtttacttagttcgtacttaacttttacggaacttaaccgaagaaccggtaacccaaacccgaacgtaaggttccggttgggttccgggttaccgggacgggtaacgggaacgtaacgggtttccgacccgttccgtcggtacgaccggttacccgacggtcctcccgccccgttaggtcccttacgttcccgttcccgttcccc

SEQ ID NO: 303467 - DNA, 634 bp, Homo sapiens
  misc_feature: GZ8MTXP01ALRFE.25.22.B11.1.454.CMB.2.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (381)..(381): a, c, t, g, unknown or other
  misc_feature (381)..(381): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctctgcactggaaccngccgtgactagttggtcgactttaataactntcgtctcctggtcccaacaacacccaggcaacggaccccaaactcatctatttatgatgtcagtcatcggcctcgtggtatttcgtgtcgtcttcctctgtctcagtcgtcggcactccggcctccctgacngtcgtcgggtctcgaggtctaggacggacgacggtacttacttagttattcgacttactttaccgaattaaccgaaggaaccgtaaccaaccctaaacgtacgttaccgtgggttcggttacggggaccgggtaacggggtaactaaacgggttccgtaacccggttcccgtacgggttaccacggaccccgaacgggtcccgtcccgtcccccgttcgggtcccttaccttcccggtttcccgttccccccg

SEQ ID NO: 303468 - DNA, 782 bp, Homo sapiens
  misc_feature: GZ8MTXP01EYIHA.25.22.B11.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcaactggaaccngccgtgacattggtntcttataactatgtctcctcgtcccaacaacacccaggccaacgaccccaaactcatctatttangatgtcagtcagtccggcctctggtagtttcgtcggtctcctttctccgttggtccctcgtaaacgttcgtacgggcctaaaccgtcccgggtcccttcccccgttagtaccccgtaaacgttcccggttcccgggggtccgttacccgaacggggtccgttacggggaaacggggtaacccggtacgggtacccgtttaaccgttttaaatttaacgttcggtacgttaacctttttacggaaacggtttaaccaacgggtaaacgtaaaccccaaacccgtaaaacccgtaacggtcggtttacggggtacgggtttacccgggggtacggggaaacccggggttaaacccgtaaacggttaccggggtaaacccgtttcccgtcccggggttaccacggtttcccgaaaccgggtcctacccggtccccccgttcgggttacccgttacctttcccgttcccggtttaacccccccg

SEQ ID NO: 303469 - DNA, 695 bp, Homo sapiens
  misc_feature: GZ8MTXP01BLIIT.25.22.B11.1.454.CMB.2.raw
  modified_base (220)..(220): a, c, t, g, unknown or other
  misc_feature (220)..(220): n is a, c, g, or t
  modified_base (310)..(310): a, c, t, g, unknown or other
  misc_feature (310)..(310): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactattcgggtgcttaataactatcgtctcctcgtacccaaacaacacccaggccaaacggacccccaaactcatactatttangatgtcagtcacgtccgtccctcgttggtacgtttcgtcggtcgtcttccgtcgtcggcctcccgaagtcctcgggcctaaccggtcccggcccttccctacgacctacgtcccggtcggggtcctccggaacgggccgtaggacgggacggtaggtcctttaaacgtttgttaacgtcgtacttattaccggaattaccgaagtaacgaacccaaccgtaacgtacggttacgttcgggtacgggttacgggacgggaacgggtaaccgtaaacggttcggacccgttccggtacggtacccgacggttccccggttaaacgggtcccttcccgggtaaccccccgttcggttcccgacccgttcccgtttcccgttaaccccc

SEQ ID NO: 303470 - DNA, 503 bp, Homo sapiens
  misc_feature: GZ8MTXP02HO1YI.25.22.B11.1.454.CMB.2.raw
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggngcttataactatgtctcctggtcccaacaacacccaggcaacggcccccaaatcatcatttangatgtcagtcatcggccctctggatttctggtcgcttcctctgctccagtctgcactcggcctcctgaccatctcggggctcccgagtcngagacgaggctacttattattgtctattntattacagagacacaacatctgtgttcgcgaggacgagtagacgtcgtcgtcgacgccgacgcgcgcccgtccgtcgctctcgttccc

SEQ ID NO: 303471 - DNA, 497 bp, Homo sapiens
  misc_feature: GZ8MTXP02JN5JD.25.22.B11.1.454.CMB.2.raw
  modified_base (233)..(233): a, c, t, g, unknown or other
  misc_feature (233)..(233): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacacaccaggcaaggccccaaactcatcatttatgatgtcagtcatcggccctctggagtttctggtcgtcttcctctggctccaagtctggcaactcggcctcctgacccatctcggggctccaggctgagacgagctacttatatgcatttcatacaganacacaacagtctgtgtcgngaggaccagttgaccgtctcggcacgccaaggctcgcccctggtcactcgtcttcccc

SEQ ID NO: 303472 - DNA, 606 bp, Homo sapiens
  misc_feature: GZ8MTXP02JSVGR.25.22.B11.1.454.CMB.2.raw
  modified_base (234)..(234): a, c, t, g, unknown or other
  misc_feature (234)..(234): n is a, c, g, or t
  modified_base (298)..(299): a, c, t, g, unknown or other
  misc_feature (298)..(299): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggngcttataactatgtctcctggtcccaacaacacccaggcaacggcccccaaactcatcatttannatgtcagtcacgtccggccctcgtggtagtttcgtggtcgtcttcctcgtcgctacagtctggccaccgtccggccctccgtacgaccctcgtccggtccggggtcctccgacggcgtaggacgggacggacggtacctttaactttattacgttcgtacttatttacatacgagaacgaacaaccgaacgtagttacgtgggtcggttacgggacgggtaacgggtaccgtaggtccggtaccgtccgtcggaccacgacccgaggtccgtccgccccgtcgtacctaccgttccgtccgtccccc

SEQ ID NO: 303473 - DNA, 510 bp, Homo sapiens
  misc_feature: GZ8MTXP02J2TOJ.25.22.B11.1.454.CMB.2.raw
  modified_base (294)..(294): a, c, t, g, unknown or other
  misc_feature (294)..(294): n is a, c, g, or t
  modified_base (374)..(374): a, c, t, g, unknown or other
  misc_feature (374)..(374): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtgcttataactatgtctcctgtcccaacaacacccaggcaaggcccccaaatcatcatttangatgtcagtcatcggccctctggagtttctggtcgcttcctctggctccagtctgggcaactcggcctccctgaccatcncggggctccaggctggagcgagctacgttattatgcatttcatacagagacacaacagtctggtgttcgcgggaggaccaagttgaccgtcctcggtcacgcccaaggctcgcccctcggtcacgtctcgtccccg

SEQ ID NO: 303474 - DNA, 503 bp, Homo sapiens
  misc_feature: GZ8MTXP02HIHBR.25.22.B11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
  modified_base (494)..(494): a, c, t, g, unknown or other
  misc_feature (494)..(494): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggccccaaatcatcatttangatgtcagtcatcggccctntggatttctggtcgcttcctctgctcaagtctggcaactcggcctcctgaccatctcggggctccaggctgagcgagctactattatgcatttcattacaganacaccaacagtctggtnttcggcggaggaccaagttgaccgtcncgtcacgcccaaggctcgcccctcgtacacttcncgttccccg

SEQ ID NO: 303475 - DNA, 536 bp, Homo sapiens
  misc_feature: GZ8MTXP02HI1SO.25.22.B11.1.454.CMB.2.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactggaaccagccgtgacattggtncttataactatgtctcctggtcccaacaacacccaggcaacggcccccaaactcatcatttangatgtcagtcatcggccctctggtatttctggtcgcttcctctgctcagtctgcactcgcctcctgacntcncgggctccgagctgaggacgaggctaacttattattgctatttcattacagtagacaaccaaanacgtctaggtgttcggnggaacgggacctaaggttcgaacccgtcgtacggtccgaacgcccgaaggccgtcgcccccgtcggtcaccgtcttcgttccccc

SEQ ID NO: 303476 - DNA, 526 bp, Homo sapiens
  misc_feature: GZ8MTXP02GULCO.25.22.B11.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (371)..(371): a, c, t, g, unknown or other
  misc_feature (371)..(371): n is a, c, g, or t
  modified_base (439)..(439): a, c, t, g, unknown or other
  misc_feature (439)..(439): n is a, c, g, or t
  modified_base (479)..(479): a, c, t, g, unknown or other
  misc_feature (479)..(479): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactntgtctcctggtcccaacaacacccaggcaacggcccccaaatcatcatttangatgtcagtcatcggccctntggtatttctggtcgtcttcctctggctcagtctggcaactcggcctcctgaccntctcggggctcccgaggctggaggacgaggcttacttattattgctatttcatacagagacaccaaangtactggtgttcgggacggaggacctaagtcgaccgtccncggtacacgacccaaggcctcgcccctaggtccacgtctcgttcccc

SEQ ID NO: 303477 - DNA, 586 bp, Homo sapiens
  misc_feature: GZ8MTXP02H5IOF.25.22.B11.1.454.CMB.2.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (453)..(453): a, c, t, g, unknown or other
  misc_feature (453)..(453): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacaccaggcaagccccaaatcatcatttatgatgtcagtcatcggcctntggattctggtcnctttccctctgctactaagtctcgcctaacgtccgccctccctacgacctactccgtccggggtccaccgacggcgtaggaggacggacggtacttaacttaacttattagtactatttactaataanaagaacgaacaacaaacgaacgtacgtcggttggtcggtacgggaacgggaacgtaaacgtacgtaccgtccgtcgtacgacgaccgaaccgaacccgaacccaacctacgtactacctaccttaccgtaccc

SEQ ID NO: 303478 - DNA, 519 bp, Homo sapiens
  misc_feature: GZ8MTXP02GEBLV.25.22.B11.1.454.CMB.2.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacatttggtncttataactatgtctcctggtcccaacaacacccaggcaacggcccccaaactcatcatttangatgtcagtcatcggccctctggtatttctgtcgcttctctgctcagtctgcactcgcctcctgaccatctcgggctccgagctgagacgaggctacttatatgctatttcattacagacgacaccaacagtctggtgtcggcgaggaccaaggttcgaccgtccgtacgtcgaacgcccgaaggcttcgcccccttggcctactccgtcgtttcccccc

SEQ ID NO: 303479 - DNA, 636 bp, Homo sapiens
  misc_feature: GZ8MTXP02H6O06.25.22.B11.1.454.CMB.2.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttataactatgtctcctggtcccaacaacaccaggcaacggcccccaaatcatcatttangagccactaagcgacctnaggtatttcaatcgtcttctctcggctccaagtctggcacgcaccggtcctcccctagacctaactcttcgtcgggcctccgaggcctaggacggacgtaggcttaggatttagttacctgtacttaacctctaattacgtacgggaaccaactaatacccgtaaaactaaaaccgtttcccccgtagtttacccgggaacccgttacgggggaaccccgtaacgggggttccctaaacccgggttcccgttacggggtaccaccggaccccgaaacggcccccaaaaccccgtctacggtcccaccgtttaccttccccg

SEQ ID NO: 303480 - DNA, 548 bp, Homo sapiens
  misc_feature: GZ8MTXP02HI79M.25.22.B11.1.454.CMB.2.raw
  modified_base (234)..(234): a, c, t, g, unknown or other
  misc_feature (234)..(234): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacaccaggcaacggccccaaactcatcatttatgatgtcagtcatcggccctctggtagtttctggtcgtcttcctctgctcaagtctgcaactcggcctcctgaccatcgtcggggctccgagctgaggacgaggcttacgttattattgactatttacattacagtacgaactaccaacagtcgtggttgttcggacggaggtacctaaggttcgacccgtcgtcggtacacgcccgaaggccgttcgcccccgttcggtcctaccgtcgttccgtttcccccg

SEQ ID NO: 303481 - DNA, 510 bp, Homo sapiens
  misc_feature: GZ8MTXP02JK7MU.25.22.B11.1.454.CMB.2.raw
  modified_base (297)..(297): a, c, t, g, unknown or other
  misc_feature (297)..(297): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggcccccaaactcatcatttangatgtcagtcatcggccctctggatttctgtcgtcttcctctggctcaagtctgcaactcggcctcctgacatcgtcggggctccaggctgagacgaggctacttatatgactatttcatacagagacacaacagtctaggtgttcggcgaggaccaaggttcgaccgtctcggtcacgccaagctcgcccctggtccactcgtcgttccccg

SEQ ID NO: 303482 - DNA, 510 bp, Homo sapiens
  misc_feature: GZ8MTXP02GO166.25.22.B11.1.454.CMB.2.raw
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggccccaaactcatcatttatgatgtcagtcatcggccctctggtatttctggtcgcttcctctgctccaagtctggcaactcggcctccctgaccatctcggggctcccagctgagacgaggctactattattgctatttcattacagagacaccaanagtcagtgttcgnggaggaccaagttgaccgtcncggtcacgcccaaggctcgcccctacggtcactctcgttccccg

SEQ ID NO: 303483 - DNA, 534 bp, Homo sapiens
  misc_feature: GZ8MTXP02I5IF1.25.22.B11.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (425)..(425): a, c, t, g, unknown or other
  misc_feature (425)..(425): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtnctttanaactntgtctctggtccaacacacccagcaaggccccaaatcatcatttangatgtcagtcatcggccctntgagttcnggtcgcttcctctggctccaagtctggcaactcgcctcctgaccatcgtcgggctccgagctgagacaggctacttatattgctatttcatacagacacaccaanacgtctagggtcgttcgggcggaagggtaccaaaggtttcgaacccgtctcggtacaacggccccaaagggtcctcgcccccgtcggtaccacttccgtcgtttccccc

SEQ ID NO: 303484 - DNA, 546 bp, Homo sapiens
  misc_feature: GZ8MTXP02GKG82.25.22.B11.1.454.CMB.2.raw
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcgtgggttttccttgttgctcttgtaaaaggtgtccattgtcaggtgcagttggtgcagtcgtgggggagcttcgtcaagcctgggagggtcccagagactctcctgtgaagtctctggattcaccatcaatgactacttatggcctggactccgccaggctccgagggagggctgggagtggatttcatttatcagtaagtggaggtaatggactatttataatcctagactctcggaggggcccgcttcaccatcctccgaggacacggccacaatacaacttcttctcgactaagtcgaacggacgtccgagccgaggacacggcgagtactcgtgtgcgagtggttgggggttattagtgaagtgaccgtagtggttactaccctacccttaacg

SEQ ID NO: 303485 - DNA, 513 bp, Homo sapiens
  misc_feature: GZ8MTXP02FSRMG.25.22.B11.1.454.CMB.2.raw
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (435)..(435): a, c, t, g, unknown or other
  misc_feature (435)..(435): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactatgtctcctggtcccaacaacacccaggcaaggcccccaaactcatcatttangatgtcagtcatcggccctctggatttctggtcgcttcctctgctccaagtctggcaactcggcctccctgaccatctcggggctcccgagctgaggacgaggctacttattattgctatttcatacagagacaccaanagtctggtgttcggcggaggaccaagttcgaccgtccgtcgtcacgccaaggctcgcccctcggtcactctcgtcccc

SEQ ID NO: 303486 - DNA, 526 bp, Homo sapiens
  misc_feature: GZ8MTXP02G1UUT.25.22.B11.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (442)..(442): a, c, t, g, unknown or other
  misc_feature (442)..(442): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacatttggncttataactntgtctcctggtcccaacaacacccaggcaaggcccccaaactcatcatttatgatgtcagtcatcggccctctggagtttctggtcgcttcctctggctccaagtctggcaactcggcctccctgaccatctcggggctcccagctgaggacgaggctacgttattattgactatttacattacagagacaaccaanagtctggtgttcggacggagggaccaaacgtgaccgtcgcgggtcacgcccaaggctcgccccctggccactctcgttcccccg

SEQ ID NO: 303487 - DNA, 545 bp, Homo sapiens
  misc_feature: GZ8MTXP02HN9X3.25.22.B11.1.454.CMB.2.raw
  modified_base (297)..(297): a, c, t, g, unknown or other
  misc_feature (297)..(297): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggcccccaaatcatcatttangatgtcagtcatcggccctctggtagtttctggtcgcttccctctggctctaagtcttggccaactcgcctccctgaccatccgtcggggctccgagctggaggacgaggtctacgttattattgactatttcaattacagaagacaccaacagtcgtggtgttcggcggtagggaccaaggttcgaccgtccgtacggtcacgaccccaaggcctcgaccccctcggtccaccgtcttcgttccccc

SEQ ID NO: 303488 - DNA, 574 bp, Homo sapiens
  misc_feature: GZ8MTXP02HU2JN.25.22.B11.1.454.CMB.2.raw
  modified_base (303)..(303): a, c, t, g, unknown or other
  misc_feature (303)..(303): n is a, c, g, or t
  modified_base (562)..(562): a, c, t, g, unknown or other
  misc_feature (562)..(562): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgctttaataactatcgtctcctggtcccaacaaccacccaggcaacggcccccaaatcatcatttangatgtcagtcatccggccctgtggtagtttctggtcgtcttcctcgtcggtctcctaagttcgtgggcctaaaccgtccggccccttccccgtagaccctactccggtcggggcctacccgaggtcctaggacgggacgaggtcttaacgttattagttcgactatttcattacaggaacacaacaacagtcgtggtcgttcggacggacggaccaagttcgaccgtcgtacgtcacgccaagtctcgccctcgtaccnctcgtcgtcccc

SEQ ID NO: 303489 - DNA, 539 bp, Homo sapiens
  misc_feature: GZ8MTXP02IA6N0.25.22.B11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (440)..(440): a, c, t, g, unknown or other
  misc_feature (440)..(440): n is a, c, g, or t
  modified_base (523)..(523): a, c, t, g, unknown or other
  misc_feature (523)..(523): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactggaaccngccgtgacattggtgctttanaactatgtctcctggtcccaacaacacccaggcaacggcccccaaactcatcatttatgatgtcagtcatcggccctctggatttctggtcgcttcctctcggctccagtctggcaacttcggcctccctgaccatctcggggctccagctgagacgaggctactattatgactatttcattacagacgacaccaaacngtctggtagttcgggacggacggggacctaaaggttcgaaccgtcctcggtcaacgcccaaggtcctcgccccctcggtaccncttcctcgtttccccc

SEQ ID NO: 303490 - DNA, 554 bp, Homo sapiens
  misc_feature: GZ8MTXP02FWU22.25.22.B11.1.454.CMB.2.raw
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
tcagactgtacagtcacgaccggtgctcgatttagacgacagctcaggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggcccccgggcagagggtcgacatctcttgttctggaagtcgctccaacgtcggcagtaatagtgtaagctggtaccagcaactcccaggaaccgcccccacactcctcatgtatgggaatgatcagcgcccctnacggggtccctgaccccgattcnctgcctccacgtctcggcacctcacgccctccctggccatcccgtggctccgaatctgagatgagccgaattattattgtgcaggcgtgggatgactaagggaagaacggttatgtacgttacggaaagtttcggggaaacctaagggtcctaaccggtccttagggtccacggacccgaaacggccccaaaccccgactcgtaccc

SEQ ID NO: 303491 - DNA, 493 bp, Homo sapiens
  misc_feature: GZ8MTXP02IBNSZ.25.22.B11.1.454.CMB.2.raw
  modified_base (435)..(435): a, c, t, g, unknown or other
  misc_feature (435)..(435): n is a, c, g, or t
  modified_base (492)..(492): a, c, t, g, unknown or other
  misc_feature (492)..(492): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttaataactatgtctctggtccaacaacaccaggcaacgccccaaactcatcatttatgatgtcagtcatcggcctctggtatttctggtcgcttcctctgctcagtctgcactcgcctcctgaccatcgcggctcgagctggagacgaggcttacgtattattgctatttcatacagagacacaacagtctgtgtcggngacggacagttcgactcgtcgtcacgccagctcgccctcgctacgttcgttaccccnc

SEQ ID NO: 303492 - DNA, 523 bp, Homo sapiens
  misc_feature: GZ8MTXP02G178L.25.22.B11.1.454.CMB.2.raw
  modified_base (294)..(294): a, c, t, g, unknown or other
  misc_feature (294)..(294): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttangatgtcagtcatcggccctctggagtttctggtcgtcttcctctggctccaagtctggcaactcggcctccctgaccatctcggggctccgaggctgagcgaggctacttattatgactatttcatacagagacaccaacagtctggtgttcggcggacggacctaaggttcgaccgtcctcggtcacgcccaaggcctcgccccctggtcctactttcgtccctaccc

SEQ ID NO: 303493 - DNA, 529 bp, Homo sapiens
  misc_feature: GZ8MTXP02HR81F.25.22.B11.1.454.CMB.2.raw
  modified_base (234)..(234): a, c, t, g, unknown or other
  misc_feature (234)..(234): n is a, c, g, or t
  modified_base (433)..(433): a, c, t, g, unknown or other
  misc_feature (433)..(433): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctctggtcccaacaacaccaggcaacggcccccaaactcatcatttatgatgtcagtcatcggccctctggagtttctggtcgcttcctctggctccaagtctggcaactcgcctccctgaccatctcgggctccgagctgagacgaggctacttattattgctatttcatacagagacaccaaanagtctggtgttcgggacggagggtaccaaaggtttcgaaccgtccgtcggtcaacgcccaaaggcctcgccccctggtccaccttcgtcttccccc

SEQ ID NO: 303494 - DNA, 522 bp, Homo sapiens
  misc_feature: GZ8MTXP02GH75J.25.22.B11.1.454.CMB.2.raw
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttangatgtcagtcatcggccctctggtagtttctggtcgtcttctctgctccaagtctggcaactcggcctcctgaccatctcggggctccgagctgagacgaggctacttatattgctatttcatacagagacacaanagtctaggtgttcggacggtaggacctaagttcgaccgtccgtcggtcacgcccaaggcctcgccccgtcggtctactcgtcgttccccc

SEQ ID NO: 303495 - DNA, 543 bp, Homo sapiens
  misc_feature: GZ8MTXP02JDIE0.25.22.B11.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (510)..(510): a, c, t, g, unknown or other
  misc_feature (510)..(510): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactntgtctcctggtcccaacaacacccaggcaaacggcccccaaactcatcatttangatgtcagtcatcggccctctggtagtttcgtggtcgtcttcctctggtctccaagtcttggccaactcggcctccctgacctatcgtcggggctaccgnggctgaggacgnggcttacgttattatgctatttnatacagagacaaccgacagtctggtgttcggcggaggaccaaggttcgaccgtcgtcggtcacgcccaaggtcccnccgtccccgtcggtcctaccttccgtcgtcccc

SEQ ID NO: 303496 - DNA, 518 bp, Homo sapiens
  misc_feature: GZ8MTXP02FHRAV.25.22.B11.1.454.CMB.2.raw
  modified_base (325)..(325): a, c, t, g, unknown or other
  misc_feature (325)..(325): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactgggaaccagccgtgacattggtgcttataactatgtctcctggtccaacaacacccaggcaaggcccccaaactcatcatttatgatgtcagtcatcggccctctggagtttcnggtcgcttcctctgctcaagtctggcaactcggcctccctgaccatctcgggggctcccaggctgaggacgaggctacttattattgcatttcatacagagacacccaacagtctggtgttcggcggagggaccaaagttgaccgtcctcggtcagcccaaggctcgccccctcggtcactctcgttcccccg

SEQ ID NO: 303497 - DNA, 539 bp, Homo sapiens
  misc_feature: GZ8MTXP02F5ITT.25.22.B11.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggncttataactntgtctcctgtcccaacacaccagcaagccccaaatcatcatttangatgtcagtcatcggccctntggtatttcnggtcgtcttcctctgctcaagtctggcaactcggcctccctgaccatctcggggctccgagctgagacgagtctacttagtactgtactatttcaatacagaagaccaaccaacgagtcgtaggtgttacgggacggacggaactaggttcgacccgtcgtacggtcaacgccccgaaaggccgttccgaccccgtcggtccaccgtccgtcgttaccccc

SEQ ID NO: 303498 - DNA, 734 bp, Homo sapiens
  misc_feature: GZ8MTXP02JAYRE.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (291)..(291): a, c, t, g, unknown or other
  misc_feature (291)..(291): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactntgtctctgtccaacacaccaggcaaggccccaaatcatcatttangatgtcagtcacgtccgcctgtggtacttcgtggtctcttcctcgtcgtcctaccgtaagtcgtacggcctaaccgtcccggtcccttcccgtacgtaacccgtacgttcccgggtcccgggggtacccttacccggacgggtccgtacgggaacgggtaaccggtacggttacctttaacgtttaagttacgttcgtaccttaacttttacaaacgttaacgaaacggtaaccgtaaaccctaaaacccgtaaacgttacggttacggttacggggttacgggttaccggggaacggggtaaacgggtaaacccgttaaaacggggttcccggtaaccccggttaccgttaccgggtaccgaacccggtaccccgaaacggtccccgtaccccggtcccccgttacggtaccctacccgtttcccgttacccgtttaccccc

SEQ ID NO: 303499 - DNA, 539 bp, Homo sapiens
  misc_feature: GZ8MTXP02JDYAY.25.22.B11.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (456)..(456): a, c, t, g, unknown or other
  misc_feature (456)..(456): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactntgtctctgtccaacacaccagcaagccccaaatcatcatttangatgtcagtcatcggccctntggtagtttcnggtcgtcttcctctgctcagtctggctaactcggcctcctgaccatccgtcggggctcccgaggctggacgacgacggcttaacgttattatgtactatttcattacagagaaccacaactagtcttggtcgttcgggnggaacgggtacctaaggttcgaccgtccgtcggtcacgccaaggccgtccgcccccgtcggtccaccttcctccggttccccc

SEQ ID NO: 303500 - DNA, 519 bp, Homo sapiens
  misc_feature: GZ8MTXP02JE4NQ.25.22.B11.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcggtcaccatctcctgcactggaacccagccgtgacattggtgcttataactatgtctcctggtcccaacaacacccaggcaaggcccccaaactcatcatttangatgtcagtcatcggccctntggatttcngtcgcttctctgctcagtctggcactcggcctccctgaccatctcggggctccgaggctgaggacgacggcttacttattattgcctattttcattacagagacaccaacagtctggtgttcggcggagggaccaagttcgaccgtcgtcggtcacgccccaaggctcgcccctcggtcacctctcgttcccc

SEQ ID NO: 303501 - DNA, 535 bp, Homo sapiens
  misc_feature: GZ8MTXP02JTP7O.25.22.B11.1.454.CMB.2.raw
  modified_base (297)..(297): a, c, t, g, unknown or other
  misc_feature (297)..(297): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggcccccaaatcatcatttangatgtcagtcatcggccctctggtagtttctggtcgcttcctctggctcagtctggcaactcggcctcctgaccatcgtcggggcctccgaggctgaggacgaggcttacgttattattgactatttcatacaganacaccaangtctggtgttcggcggaggtaccaaggttcgaccgtcctacggtcaacgccctaaggcctccgcccccgtcggtcaccgttctccgttaccccc

SEQ ID NO: 303502 - DNA, 611 bp, Homo sapiens
  misc_feature: GZ8MTXP02HHMIP.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaaccngccgtgactagttggtntactttaataactatcgtctccgtcggtacccaaacaaccaccgacggacaaccgaccccaaactcactactaatttangtatgtacagtcacgtccgtccctcgtggtacgtttcgtggtcgtcttcctcgtcgctacagtctgcctacgtccgcctcctacgaccacgtccgtcgggctccgacgcgaggaggacgacgtacgttaacttattattagtactattactataactaagaacgaacaacaacgtacgtacgtcggtcggttacgggtacgggaacgggaacgtaacggtacgtaccgtaccgtacgtacgaccgaccgacgaaccgtccgtcccgtccgtaccgtaccgtccgttccgtcccg

SEQ ID NO: 303503 - DNA, 688 bp, Homo sapiens
  misc_feature: GZ8MTXP02HC13P.25.22.B11.1.454.CMB.2.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcgtcaccatctcctgcactggaaccngccgtgactattgggtnctttaataacttntcgtctctcgaccaacaaccaccagacaaccgacccaatcatactattatagtatgtacagtcacgtccgtcctgtggtagtttcgtggtctcttcctcgtcgtctacgtagtcgtcggcctaaccgtccgtccctccgtacgacctacgtccggtccgggacctaccggacggtcgtaggacggacggtacggtacgttaacttaacttattacgtacttactttactaactaacgtaacgaacgaaaccaaacctaaacgtaacgttacgttacgggttacgggttacggggtacggggtaacgggtaaaccggtaaacggttaaccggtacccggttacccggttaccggtaccgtaaccggaacccggaaccggtaacccgtcccggtacccccggtacccggtacccgtaccgttacccgtttacccgttaccccg

SEQ ID NO: 303504 - DNA, 549 bp, Homo sapiens
  misc_feature: GZ8MTXP02I95T8.25.22.B11.1.454.CMB.2.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (289)..(290): a, c, t, g, unknown or other
  misc_feature (289)..(290): n is a, c, g, or t
  modified_base (308)..(308): a, c, t, g, unknown or other
  misc_feature (308)..(308): n is a, c, g, or t
  modified_base (428)..(428): a, c, t, g, unknown or other
  misc_feature (428)..(428): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtncttanaactatgtctctgtcccaacacaccagcaacggccccaaatcatcatttannatgtcatcatcggccctntggtagtttctggtcgtcttcctctggctcagtctgcaactcggcctcctgaccatcgtccggggctcccgagcctggacggacgacggcttacgttattatgactatttcattacaganacaaccgacagtctagtggttcggcggaacgggtactaaaggttcgacccgtcgtcgggtccacggccccgtaaggcctccggtcccccgtcggtcctacccgttccgtccgtttcccccg

SEQ ID NO: 303505 - DNA, 547 bp, Homo sapiens
  misc_feature: GZ8MTXP02FWYHO.25.22.B11.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgccaggtgcagttggtgcagtctgggggaggcttcgtcaagcctggagggtccctgagactctcctgtgaagtctctggattcaccatcaatgactactttanggcctggatccgccaggcctccgaggggaaggggctgggagtggatttcatttatcagtaatggagtaatggactatttanaatccagtacctctccggagggccncttcaccatctccgagggacacggccaacaatacaacttcttctgcaagtcgaacgacgtacccgagccgagacgacgccgtgtacttcgtgtgcgtagaggttgggggttattagtgaagtcgccgtagtggttactacccgtacccttacg

SEQ ID NO: 303506 - DNA, 588 bp, Homo sapiens
  misc_feature: GZ8MTXP02G38DQ.25.22.B11.1.454.CMB.2.raw
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgctttaataactatgtctcctggtcccaacaacacccaggcaacggccccaaactcatcatttatgatgtcagtcagtcgccctctggtagtttctggtcgtcttcctctggtctcagtctgctaactcggcctccctgaccatcgtcgggctccgagcgtgacggacgaggacttacgttattattgtacttatttacattacagacgaaccaacccaaacaacgttccgtaggttcggtttaccgggcgggtaacgggtaacccgaaggtttcgaacccggttccgttccggtacgaccgtaccgaacggtcgtccgtcccccgtcggtccacttccgtcgtttcccccg

SEQ ID NO: 303507 - DNA, 521 bp, Homo sapiens
  misc_feature: GZ8MTXP02H5TCL.25.22.B11.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccacctcctgcactggaaccngccgtgacattggncttataactntgtctcctggtcccaacaacacccaggcaacggccccaaactcatcatttangatgtcagtcatcggccctctggtagtttcnggtcgctttctcctggctccaagtctggcactcggctccctgaccatctcggggctccgaggcctgaggacgaggctacttattattgctatttcattacaganacaccaacagtctggngtttcggnggtaggaccaagttcgaccgtctcggcacgccaaggctcgcccctcggtcactctcgttcccgccc

SEQ ID NO: 303508 - DNA, 498 bp, Homo sapiens
  misc_feature: GZ8MTXP02IWQ7W.25.22.B11.1.454.CMB.2.raw
  modified_base (294)..(294): a, c, t, g, unknown or other
  misc_feature (294)..(294): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggccccaaactcatcatttangatgtcagtcatcggccctctggagtttctggtcgcttctctgctcagtctgcactcgcctcctgaccatctcgggctccagctgagacgaggctactattatgactatttcattacagagacacaacagtctggtgttcggcgaggaccaagttcgaccgtctcggtcacgtcccaaggctcgccctcgcactctcgttcccc

SEQ ID NO: 303509 - DNA, 531 bp, Homo sapiens
  misc_feature: GZ8MTXP02IDD5Y.25.22.B11.1.454.CMB.2.raw
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctgtccaacacaccaggcaacgccccaaactcatcatttangatgtcagtcatcggccctctggagtttctggtcgtcttcctctgctcagtcngcactcgcctcctgcatcgtcgggctccgaggctgaggacgaggtcttacgttattattgctatttcatacagacgaacaccaacagttcgtaggttgttcgggcggaggtaccgaaggttcgaccgtcgtcggtcaacgcccaaggccgtaccgccccgtacggtccaccttcctcgtttccccc

SEQ ID NO: 303510 - DNA, 617 bp, Homo sapiens
  misc_feature: GZ8MTXP02G3RJJ.25.22.B11.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (465)..(465): a, c, t, g, unknown or other
  misc_feature (465)..(465): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgacattggtncttataactntgtctctggtccaacaacaccagcaacgccccaaatcatcatttangatgcagtcatcgccctgtggtatttcgtggtcgcttcctctggctcgaagtctggctaacgtccggccctcccgtcgacctactccgtcggggtcctacccgaggtccaggacgacgtacggcttacttattatgacttatttcattacgagtacgaacaaccaacgagttcgngggttcgttacgggacggtaacggggaacctaacgggtttcgaacccgttcccgttacgggtaccgaacggtacccccgtaaaggccccgttaccggtacccccccgttcgggtaaccctacccgtttacccggttaccgtttccccccccg

SEQ ID NO: 303511 - DNA, 528 bp, Homo sapiens
  misc_feature: GZ8MTXP02JZERC.25.22.B11.1.454.CMB.2.raw
  modified_base (292)..(292): a, c, t, g, unknown or other
  misc_feature (292)..(292): n is a, c, g, or t
  modified_base (433)..(433): a, c, t, g, unknown or other
  misc_feature (433)..(433): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctctgtccaacaacaccaggcaaggcccccaaatcatcatttangatgtcagtcatcggccctctggagtttctggtcgcttcctctgctccagtctggcaactcggcctcctgaccatctcggggctccggggctggaggacgaggctacgttattattgctatttcattacagagacaccaanagtctggtgttcgggcgagggaccctaaggttcgaccgtcctcgggtacaacgccccaaggcctcggccccctggccactctcgttccccgcccc

SEQ ID NO: 303512 - DNA, 617 bp, Homo sapiens
  misc_feature: GZ8MTXP02H16ZL.25.22.B11.1.454.CMB.2.raw
  modified_base (296)..(297): a, c, t, g, unknown or other
  misc_feature (296)..(297): n is a, c, g, or t
  modified_base (353)..(353): a, c, t, g, unknown or other
  misc_feature (353)..(353): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttaataactatgttctcctggtcccaacaacaccagcaacgccccaaatcatcatttannatgcagtcatcggccctgtgtagtttctggtcgtcttcctctcgtctcaagttcgngcaacgtcgccctccctgaccatccgtccgggctccgaggctggaggacgaggtacttaacgttattagttgtacttaattttcaattacagaagaccaactaaactgttaccgtggttacggttaccgggacgggtaacgggtaaccgtaaaggtttccggaaacccggttcccgtacgggttaccgaccggtaacccgaaacgggtcccgtcggtaccccccggttcggtaccctacccgttccgtttcccggttccccccg

SEQ ID NO: 303513 - DNA, 518 bp, Homo sapiens
  misc_feature: GZ8MTXP02G0TJF.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactntgtctcctggtcccaacaacacccaggcaacggcccccaaactcatcatttangatgtcagtcatcggccctntggtagtttctggtcgtcttcctctggctcagtctgcactcggcctcctgacntcgcgggctccgagctgagacgnggtctacgttattattgctatttcattacagacgaacaccaacagtctggtgttcggacggacggactaaggttcgaccgtctcggtcacgccaaggctcgcccctcggcactcgtcgtccccg

SEQ ID NO: 303514 - DNA, 624 bp, Homo sapiens
  misc_feature: GZ8MTXP02HMVCU.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccagccgtgacagtttggtgtactttaataaacttatcgtctcctcggtacccaacaaccacccaggaccaacggacccccaaactcactctaatttatgatgtcagtcacgtccgccctcgtggtagtttcgtggtcgtcttcctctcggtctctagtctggctaacgtcggcctcctcgaccatccgtcggggtctcccgacgcgtggacggacgaggcttactttagttacttcgtacttatttactaattacgagacgaaccaaccaacgtacgtacgtgggttcgttacggggacgggtaacgggtacgtaaacggttcgtaacccgtccgttccggacacggacccgaacggtcccgtaccggcccccgttcggtacctccgtccgttccgttcccccg

SEQ ID NO: 303515 - DNA, 520 bp, Homo sapiens
  misc_feature: GZ8MTXP02FV3OY.25.22.B11.1.454.CMB.2.raw
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (433)..(433): a, c, t, g, unknown or other
  misc_feature (433)..(433): n is a, c, g, or t
tcagactgtacagtcacgaccggtgctcgatttagacgacagctcagggggggtctcagggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacaccaggcaaggccccaaatcatcatttangatgtcagtcatcggccctntggtatttctggtcgcttctctgctcaagtctggcactcggcctccctgaccatctcggggctccgagctgaggacgaggtctacgttattatgtctatttcatacagagacaccaanagtctggtgttcggcgagggaccaagttcgaccgtcgtcggtcacgccaacggcctcgccccgtcggctacctccgtcgttcccccg

SEQ ID NO: 303516 - DNA, 565 bp, Homo sapiens
  misc_feature: GZ8MTXP02HJGIE.25.22.B11.1.454.CMB.2.raw
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagcgtggttttcctgttgctcttgtaaaggtgtccattgtcaggtgcagttggtgcagtctgggggagcttcgtcaagcctggagggtcccagagactctcctgtgaagtctctggattcaccatcaatgacttactttanggcctggatccgcaggctcgagggagggctgggatggatttcatttncagtaanggagtatggctatttanaatcagtactcgtacggaggggtcccncgttcacctactctccgaggacacggcaacatacaactcttctgctaagtagacgacgtccgacgcgacggacgacggccgttgtaccgttcgtggtgacgtaggtaggttacgggggttaattggtagtaagtcggtaccgtaggtttacggttacgttacccttaccccgtttaaaccg

SEQ ID NO: 303517 - DNA, 523 bp, Homo sapiens
  misc_feature: GZ8MTXP02F52KX.25.22.B11.1.454.CMB.2.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactatgtctcctggtcccaacaacacccaggcaacggcccccaaactcatcatttangatgtcagtcatcggccctctggtagtttctggtcgtcttcctctgctcaagtctggccaactcggcctccctgaccatcgtcgggctccaggctgaggacgaggcttaacttattatgctatttcatacagagacaaccaacagtctggtgttcggcggaaggacctaaggttcgaccgtctacggtcacgccaaggctccgccccgtcgcacgtcgtcttcccc

SEQ ID NO: 303518 - DNA, 510 bp, Homo sapiens
  misc_feature: GZ8MTXP02F7V6K.25.22.B11.1.454.CMB.2.raw
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactatgtctctggtcccaacaacacccaggcaaggcccccaaaactcatcatttangatgtcagtcatcggccctctggtatttcnggtcgcttcctctggctccagtctggcaactcggcctccctgaccatctcggggctccgaggctgagacgaggctacttatatgactatttcatacagagacaaccanagtctggtgttcggnggaggacctaagtgaccgtcgttcggcacgcccaaggctcgcccctcggcacgtctctcccc

SEQ ID NO: 303519 - DNA, 544 bp, Homo sapiens
  misc_feature: GZ8MTXP02HYF76.25.22.B11.1.454.CMB.2.raw
  modified_base (292)..(292): a, c, t, g, unknown or other
  misc_feature (292)..(292): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
tcagactgtacagtcacgaccggtgctcgatttagacgacagctcaggggagctctgggagaagagcccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagccgtggacgggtccctgagactctcctgtgagtctctggattcaccatacaatgacttactttancgcctggactccgcaggcctcgaggggagggctagggagtcggtattctatttatcagttaatgggaagtaatggactatttanaactcaagcttcgccggagggccctntcacntcacgaggacaacggctaacatacaactcgtttcngactagacgacgcgcgagacgagacgcgcgtcgtactcgtgngcgaggtaggttaggttagtagtagtgtcgtacgtacgtacgttacttaccttacctacg

SEQ ID NO: 303520 - DNA, 507 bp, Homo sapiens
  misc_feature: GZ8MTXP02ICZOS.25.22.B11.1.454.CMB.2.raw
  modified_base (307)..(307): a, c, t, g, unknown or other
  misc_feature (307)..(307): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttatactatgtctctgtccaacacaccagcaagccccaactcatcatttatgatgtcagtcatcggccctntggtatttcgtgtcgcttcctcgtgctcagtctggctaactcgcctccctgaccatccgcgggctcgagctgacggcgaggcttaacgttattattgactatttcattacagacgacacaacagtctggtgttcggcggacggacaagttgacctcgtcggtcacgaccaggctcgccctcggactccgtctcgtccccg

SEQ ID NO: 303521 - DNA, 564 bp, Homo sapiens
  misc_feature: GZ8MTXP02H8P6I.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacagttggtnctttataactatcgtctcctggtcccaacaacaccagcaacggccccaaactcatcatttatgatgtcagtcatcggccctctggagtttctggtcgtcttcctctcggctcaagtcttggcaactcggcctccctgaccatcctcggggctccgggctcggaggacgtaggctacgttacttattgctatttcacttacagagacaaccaacagtctaggtgttcgggcgggacggaccgtaaaggttcgaacccggtcctaccgggttcacgtcccaaacggtccttccggcccccgtcggtccacgtcctcgttccccgtacccc

SEQ ID NO: 303522 - DNA, 555 bp, Homo sapiens
  misc_feature: GZ8MTXP02HOLLT.25.22.B11.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacagtttgggtncttaataactatcgtctcctggtcccaacaacacccaggcaacggccccaaactcatcatttangatgtcagtcatcggccctctggtatttctggtcgtcttcctctggctcagtcgtggctacgtcgcctccctgaccatccgtcgggctccgagctggacggacgaggtcttacttattattgctatttcattacagacacctaaccaatagtcgtgggtcgttcgggacggaacgggtactaaggttcggaccgtcgtcggtcacggtcccgaagtccgtccggccccgttcggcctccgtcttccgtcccccg

SEQ ID NO: 303523 - DNA, 511 bp, Homo sapiens
  misc_feature: GZ8MTXP02JELL3.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttataactntgtctcctgtccaacacaccaggcaaggccccaaactcatcatttangatgtcagtcatcggccctctggatttcnggtcgcttctctgctcagtctgcactcgcctcctgaccatctcggggctccagctgagacgaggctacttatatgctatttcatacagtagacacacagtctggtgttcggcggaggaccaaggttcgaaccgtcgtcggtcaacggcccaaggcctcgcccccgtcggtcctactctcggtttccccc

SEQ ID NO: 303524 - DNA, 513 bp, Homo sapiens
  misc_feature: GZ8MTXP02IZ09E.25.22.B11.1.454.CMB.2.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacaccaggcaacggccccaaactcatcatttangatgtcagtcatcggccctntggtagtttctggtcgcttctctgctccatctggcaactcggcctcctgaccatctcggggctcccgagctgagacgaggctacttatattgctatttcaatacaganacaccaanagtctggtgttcggnggagggaccaaggttcgaccgtctacggtcacgccaagctcgcccctcggcacctctcgttacccc

SEQ ID NO: 303525 - DNA, 547 bp, Homo sapiens
  misc_feature: GZ8MTXP02JSZ68.25.22.B11.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactntgtctcctggtcccaacaacaccccaggcaaggcccccaaactcatcatttangatctcagtcatcggccctctggatttctggtcgcttcctctggctcaagtctggcaactcggcctcctgaccatccgtcggggccttccgaggcctggaggacgacggctacgttattattgctatttcattacagacgacaacccgaacacgtcgtggttcgttacgggcggtagggacccgaaggtttcgaccgtccgtcggtcacgcccaaggcctcgccccctggtccactcgtcgttcccccg

SEQ ID NO: 303526 - DNA, 621 bp, Homo sapiens
  misc_feature: GZ8MTXP02HDGKC.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactntgtctcctggtcccaanaacaccaggcaacggcccccaaatcatcatttangatgtcagtcatcggccctntggtacgtttctggtcgtcttcctctggctccaagtctggcaactcggccctccctgaccatccgtcggggctacccggngcgtgaggacgagtcttaacttagttagttcgtacttactttacaacttacgaacgaacgaaccaaccgtaacgtacgttcgtgggttcggttaccgggacgggtaacgggtaaccgtaaggttaccgtacccggttaccgtacggtaccgaccgtacccgtaacggtcccgtacccggtcccccggttacggtaccctaccgtttcccgttacccgttcccccg

SEQ ID NO: 303527 - DNA, 504 bp, Homo sapiens
  misc_feature: GZ8MTXP02HWAB3.25.22.B11.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (397)..(398): a, c, t, g, unknown or other
  misc_feature (397)..(398): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacattggtnctttanaactntgtctctggtccaacaacaccaggcaacggccccaaactcatcatttatgatgtcagtcatcggcctctggtgttctgtcgcttctctgctcaagtctgcaactcgccttccngacatcgtcgggctcagctgagacgagctactattattnntatnatanagacacacanagtgtgtgtcgacggacggacgtacgtcgaccgtcgtcgacgacgaccgacgccgtccgccccgtcgtcctacctccgtccgtccccg

SEQ ID NO: 303528 - DNA, 539 bp, Homo sapiens
  misc_feature: GZ8MTXP02I7MGH.25.22.B11.1.454.CMB.2.raw
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtctgggggaggcttcgtcaagcctggagggtccctgagactctcctgtgaagtctctggattcaccatcaatgactacttatggcctggatccgcaggctccgaggggaaggggctgggagtggatttcatttatcagtaatgggagtaatggactatttataatccagtacctcgtccggagggtcccgcttcaccatctcgaggacacgcaacatacaactcttngacaagtcgaacgacgtccgagcgagacacggcgtcgtactcgngtgcgagtaggttgggggttattagtgtaagtcgtactaggtcggttactaccctaccctaac

SEQ ID NO: 303529 - DNA, 608 bp, Homo sapiens
  misc_feature: GZ8MTXP02G8M8X.25.22.B11.1.454.CMB.2.raw
  modified_base (297)..(297): a, c, t, g, unknown or other
  misc_feature (297)..(297): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgaaccctgactcagcctgcctccgtgtctgggactcctggacagtcggtcaccatctcctgcactggaaccagccgtgacattggtgcttataactatgtctcctggtcccaacaacaccaggcaacgcccccaaatcatcatttangatgtcagtcactcggcccctgtggtagtttcgtggtcgtcttccctcgtggctccaagtctggcaactcggccctcctgaccatccgtcgggctccgagcgtaggaggtacgacggtcttaacgttattacgttgacttatttacaattaccgaagaaccgaaacaacccaaacgtacggtcgttacgggttcgttacggggacggaacgggtaaccgtaaacggttcggaacccggttccgtcgggtccaaccggcccgaaacggccgtccggcccccgttcggacctccgtccgttccgtttcccccg

SEQ ID NO: 303530 - DNA, 600 bp, Homo sapiens
  misc_feature: GZ8MTXP02GUTX4.25.22.B11.1.454.CMB.2.raw
  modified_base (289)..(289): a, c, t, g, unknown or other
  misc_feature (289)..(289): n is a, c, g, or t
  modified_base (401)..(401): a, c, t, g, unknown or other
  misc_feature (401)..(401): n is a, c, g, or t
  modified_base (563)..(563): a, c, t, g, unknown or other
  misc_feature (563)..(563): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctgggagggtccctgagactctcctgtgagtctctggattcaccatcaatgacttactttanggcctggactcccgcaggcctccgaggggagggctgggagtggatttcatttatcagtatggagtaatggactaatttataaatccaagcctccgtccgggagggggtcccnctttccaccctatccgtaccgaacggggaccaaacggcccaaacaactaccaaacttctttaccagtacctaaagtacgaaccggaccgtcccggaaagcccggaaggaccgacgggtcccgtagtaccttcgtggcgacggaggtaggtttgggggtattntggaatgacctaggtcgtactacccgtacccttaacg

SEQ ID NO: 303531 - DNA, 763 bp, Homo sapiens
  misc_feature: GZ8MTXP02I5SV5.25.22.B11.1.454.CMB.2.raw
  modified_base (308)..(308): a, c, t, g, unknown or other
  misc_feature (308)..(308): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgtactttaataactattcgtctcctggtacccaacaaccacccaggcaacggcccccaaactcatcatttangatgtcagtcatccggccctcgtggtacgtttcgtggtcgtctttccctcgtggtctaccgaagttccgtcggcctaaaccgttcccgggaccccttccccgtacgaacccctacgttcccggtccgggggtacccttcccggaaggggtccgttacggggaacggggaaaccggtacggggtaccttttaaccggtttaatttacgttcggtactttaacgttttacaacgtttacaaacgggtaacgtaaaccaacccctaaagttacgttaccggttaggggtttcggttaccgggggaccgggtaacgggtaaccgttaaacgggtttccggtaaccccggttccgtaccgggttaccgtaaacccggtccccgaaaacgggtcccgtaccccgggtaccccccgttcgggtaaccctaccggtttcccgttaccccgggtttcccccccg

SEQ ID NO: 303532 - DNA, 557 bp, Homo sapiens
  misc_feature: GZ8MTXP02IK3B9.25.22.B11.1.454.CMB.2.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (463)..(463): a, c, t, g, unknown or other
  misc_feature (463)..(463): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacattggtgcttataactntgtctctggtccaanacaccagcaagccccaaactcatcatttangatgtcagtcatccggcccttctggtacgtttcnggtcgtcttcctctggtctcaagttctgctaactcggccctccctgaccatccgtcggggctcccgaggctggaggacgaggacttattattatcgactatttcattacagacgaccaccaagtagtctggtgttcgggnggtacgggtaacctaggttcgaccgttccgtacggtcaacgtcccaaggtcctaccgcccccgttcggtcctaccgttcgtccgtttacccccg

SEQ ID NO: 303533 - DNA, 541 bp, Homo sapiens
  misc_feature: GZ8MTXP02F3SQC.25.22.B11.1.454.CMB.2.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagactgtacagtcacgaccggtgctcgatttagacgacagctcagggagctctgggagaagagcccagccccagagttcccaggagtttccattcggtgatcagcactgaacacagaggactcaccatggagtttgggctgagctgggtttccttgttgctcttgtaaaaggtgtccattgtcaggtgcagttggtgcagtctgggggagcttcgtcaagcctgggagggtccctgagactctcctgtgaagtctctggattcaccatcaatgactacttatggcctggatccgcaggctccgagggagggctgggagtggatttcatttancagtaatggaagtaatggcatttanaatccaagacctcgtccggaggggcccgcttcaccatctccagggacaaccggccaacaactacaacttctttctgacaagtcgaacgacgtccgagccgaggacacggccgtgtacttcgtgtgcgagtaggttgggggttattagtgaagtgaccgtagtcggttactacctaccctaac

SEQ ID NO: 303534 - DNA, 537 bp, Homo sapiens
  misc_feature: GZ8MTXP02FNUHO.25.22.B11.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactattggncttaataactntgtctctgtccaacacaccaggcaacgccccaaatcatcatttangatgtnagtcatcggccctgtggtacgtttctggtcgtcttcctcgtgctcagtctggcactcggcctccctgaccagtcgtcgggctccgagtctaggagacgaggtcttaacgtttattattgctatttcaatacagacgaacaccaatagtctaggtgtacggcggaggtaccaggttcgaccgtccgtcggtacacgacccaaggcctccggccccctcggtccacgttccgtcgtttcccccg

SEQ ID NO: 303535 - DNA, 645 bp, Homo sapiens
  misc_feature: GZ8MTXP02G3OR3.25.22.B11.1.454.CMB.2.raw
  modified_base (409)..(409): a, c, t, g, unknown or other
  misc_feature (409)..(409): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctgggagggtccctgagactctcctgtgaagtctctggattcaccatcaatgacttacttatcggcctggatccgccgaggcctccgaggggaagggctgggagtggtatttcgatttagtcaagttaagtgggaagtaagtggactatttataactccagtactcgtccggaggggtcccncttacacccatcctaccgagggaccaaccggaccaacaactaccaacttctttctagactaagtacgaaaccgtaccgaccggaagcccgggaagaccgaccgggtacccgttagttacccgttccgtggtaccgacgggtaagggttaggggtttagggggtttaacttaaggttggaagtttacggacccgttaggtacggtttaaccctaacccccggtttacccttaaaccg

SEQ ID NO: 303536 - DNA, 521 bp, Homo sapiens
  misc_feature: GZ8MTXP02GX3V3.25.22.B11.1.454.CMB.2.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (474)..(474): a, c, t, g, unknown or other
  misc_feature (474)..(474): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtnacagttggtgcttataactntgtctctgtcccacacaccagcaacgccccaaatcatcatttangatgtcatcatcgccctctgtagttctgtcgtcttcctctgctcagtctggcactcgcctcctgacntcgcgggctccgagctgaggacgnggcttacgttattatgactatttcatacagtacgacaacccaatacgtcgtggtgttacgggcggaagggacaaggttcgaccgtcgcgtacncgcccgaaggccgtaccgccccgtcggtctacctcgtcgttcccccg

SEQ ID NO: 303537 - DNA, 650 bp, Homo sapiens
  misc_feature: GZ8MTXP02JYUM9.25.22.B11.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtntcttataactntcgtctctcgtaccaacacaccagacaaccgaccccaactcactctatttatgtatgtcagtcacgtccggtccctcgtggtacgtttactaactcgtcttcctcgtcggtcctaccgtaacgttcgtcggcgacgccgtacccggtccctacccgtacgtaacctaactccgtacgtcgggtcctaccgacggtccgtacgggacgggacggtacggtcgtagttaacgtttaacgttacgtagtaccttactactagttacgtacgaacactaactacaaactaaccgtcccgttaccgttaccggaccggtacgggaccgtacgggttacctaccggtccggtacggtaccgaaccggtacccgaaaccggacccctaacccgtaccgtacgtacctacc

SEQ ID NO: 303538 - DNA, 783 bp, Homo sapiens
  misc_feature: GZ8MTXP02IK60P.25.22.B11.1.454.CMB.2.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
tcagactgtacagtcacgaccggtgctcgatttagacgacagctcagggggggtctcaggaggcagcgctctcgggacgtctccaccatggcctgggctctgctgttcctcacccctcctcactcagggcacagggtcctgggcccagtctgccctgactcagcctgcctccgtgtctgggactcctggacagtcggtcaccatctcctgcactggaaccagccgtagactagttgggtntctttaataactatcgtctcctcggtacccaaacaaccacccaggaccaacggacccccaaactcactactatttangtatgtacagtcacgtccggccctcgtggtacgtttcgtggtcgtctttcctcgtcgccttaccgtaagttccgttacggcctaaccgttcccgggtccccttcccccgtacggaccctacgttcccgggttccgggggtcccttacccggacgggtccgttagggaaacggggtaaccgggacgggttacctttaacgttttaatttagttcgtacctttaaactttttaccaaactttaacccgaaaggtaaccgaaaacccaaaccctaaaacgtacggtttccggttaggggtttcggtttaccgggggacggggtaaacggggtaaacccgtaaaacgggtttccggaaccccggtttccggtaccgggttaccgaacccggtaacccgaaacggggtcccttaccccgggtacccccgtttccgggtaccctaccctttcccgtcccgtttaaccccccc

SEQ ID NO: 303539 - DNA, 682 bp, Homo sapiens
  misc_feature: GZ8MTXP02I84F9.25.22.B11.1.454.CMB.2.raw
  modified_base (286)..(286): a, c, t, g, unknown or other
  misc_feature (286)..(286): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggagggtccctgagactctcctgtgagtctctggattcaccatcaatgactacttanggcctggactccgcaggctccgaggggagggctgggagtggtatttcatttatcaagtatgggagttaactggactatttataatcctaagacctccgtaccgggaggggtcccgtcgttaccacctactaccgtacccgaacggggtaccaaccggaccaacaactacctaaaccttctttactacgtaccgtaaagttacggaaaccggtaccggtacccgaacggacccggaacgggaaccgaccgggtacccgtacggttaaccgtttccggttggtacggtaccgggtaacggggttaacggggttttacggggggtttaactttacggttaggtaagttcggaccgttaggttacgggtttaaccttaacccgttaacccctttaaaccg

SEQ ID NO: 303540 - DNA, 800 bp, Homo sapiens
  misc_feature: GZ8MTXP02JFRAE.25.22.B11.1.454.CMB.2.raw
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttaataactatgtctcctggtcccaacaacacccaggcaacggccccaaactcatcatttangatgtcagtcagtcggccctctggtagtttctggtcgtcttcctctggtctccgaagttcgnggcctaacgtccggtcccttacccgtgaaccctacgtcccggttccgggggcccttacccggacgggtccgttagggaacggggtaaccggaacggggtacctttaaaccgttttaacgtttaaatttcgggtaacccttaagtttttaaccgtaactttaaaccgtaacggtaaaccgggtaaaacccgaaaacccctaaaaccgtaaccgggtttacgttacggggtttccgggtttaccgggggaaccggggtaaaccgggggtaaaaccccgtaaaacggggtttcccggtaaacccccggtttcccggttaaacccggggttcccgtaaccggtttaccccggaaaacggggtccccgttacccggttacccccccccggttacggggttaccccctaccgtttaccccgttacccggtttttacccccccccg

SEQ ID NO: 303541 - DNA, 754 bp, Homo sapiens
  misc_feature: GZ8MTXP02HWRMH.25.22.B11.1.454.CMB.2.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactggaaccngccgtgacnttggncttanaactntgtctctgtccaacaacaccagcaacgccccaaatcatcatttangatgtcagtcatcggcccttagtggtagtttcgtcggtcgtcctttcctcgtcggtcctaccgtaagtccgttaggcctaaaccgttccggtccccttcccccgtagtacccctacgttcccggtccgggggtaccttcccggaggtccgtaggaacgggtacgacgggttactttaactttagtttagttacggtaccttaattttacctaatttaaccgtaagggtaaccgtaaaccctaaacccaaaacgtacggtttaccgttaggggtttcgggttaaccgggggtacggggaaacggggttaaacccgttaaaagggttttccggaaaccccgtttcccggtttaaccgggttccgtaaaaccggccccgttaaaacgggcccggtttaccccggaccccccggtttaccggggtcccctaaacccggtttcccgtttaccccggggtttcccccccg

SEQ ID NO: 303542 - DNA, 510 bp, Homo sapiens
  misc_feature: GZ8MTXP02F1GWY.25.22.B11.1.454.CMB.2.raw
  modified_base (235)..(235): a, c, t, g, unknown or other
  misc_feature (235)..(235): n is a, c, g, or t
  modified_base (326)..(326): a, c, t, g, unknown or other
  misc_feature (326)..(326): n is a, c, g, or t
  modified_base (428)..(428): a, c, t, g, unknown or other
  misc_feature (428)..(428): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagcccgtgacattggncttataactatgtctcctgtcccaacaacacccaggcaaggcccccaaatcatcatttatgatgtcagtcatcggccctctggtagtttcnggtcgcttcctctgctcagtctggcactcgcctcctgaccatcgtcgggctccgagctgagacgagtctacttatattgctatttcatacagagacaccaanagtctggtgtcggcgaggaccaagtcgaccgtcgtcggtcacgcccgaaggctcgccccctcggtccactcctcgtcccccg

SEQ ID NO: 303543 - DNA, 667 bp, Homo sapiens
  misc_feature: GZ8MTXP02HRWIQ.25.22.B11.1.454.CMB.2.raw
  modified_base (237)..(237): a, c, t, g, unknown or other
  misc_feature (237)..(237): n is a, c, g, or t
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtnctttaataactatcgtctcctcggtacccaacaaccacccaggccaacggacccccaaatcatcatttangatgtcagtcatcgcctgtgtagtttcgtggtctcttcctctgtctactagtcnggcacgtcgcctcccgtagaccctatccgtcgggccctaccgacggtctacgggaacggacggtacggtcctttaacgttaatttagttcgactttaacgtttttcaaactttaacgaagtaacggaacctaacccaaaacgtacgtacgttcgggttaggtttaccgggacgggtaacgggtaaccctaaaaggtttccggaacccgttcccggtacggttacccgaccggtaccccgaaacgggtccgttcccggtacccccgtccggttaccctaccgttcccgtttcccgtttcccccccgg

SEQ ID NO: 303544 - DNA, 693 bp, Homo sapiens
  misc_feature: GZ8MTXP02HEQYI.25.22.B11.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtncttaanaactntgtctctgtccaacacaccagcaacgcccaatcatcatttangatgtcagtcatccggccctcgtggtacgtttcgtggtcgtcttccgtcgtcggtcctaccgtaagttcgtcgggcctaaaccgttccggtaccccttccccgtacggtaaccctacgttcccggtcccgggggtccttacccggtaacgggtccgttacgggaacgggtaccggtacgggtacctttaacgttaattacgttcgtacttatttaccgacgttaacgagtaacgaaccaaacccgtaacgtaacgttcgtacggttcggttaccgggacgggtaacgggtacctaaacggttcggtaacccggttccgtacggttaccgaccggtaccccgtaaacggtcccgtacccggtcccccgttacggtaccctaccgttccgttacccgtttcccccg

SEQ ID NO: 303545 - DNA, 498 bp, Homo sapiens
  misc_feature: GZ8MTXP02JUT8P.25.22.B11.1.454.CMB.2.raw
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (402)..(403): a, c, t, g, unknown or other
  misc_feature (402)..(403): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttanaactatgtctcctggtcccaacaacacccaggcaaggcccccaaatcatcatttangatgtcagtcatcggccctctggtagtttctggtcgtcttcctctggctccaagtctggcaactcggccttcccnacntcgcggctcgngcngngagngntatatatnntntnananananacacacagtgtgtgtcggcggacggacgtagtacgtacgtcgtcgtcgacgaccgacgcgcgcccgtcgtcgtactctctccc

SEQ ID NO: 303546 - DNA, 600 bp, Homo sapiens
  misc_feature: GZ8MTXP02G0SGX.25.22.B11.1.454.CMB.2.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctctggtcccaacaacaccaggcaacgccccaaactcatcatttangatgcagtcactcggccctntggtatttcgtggtcgtcttcctcgtcggtcctccaagttccgttacgggcctaaaccgtccggcccttcccgtcgaccctatcccgtcggggccttacccgaggcctggaacggacgcggacttaacgtttattacgttgactatttacattaacagaacgaccaaccgtaaactgtcgtggttgtcgggacggaacgggtactaacggttcgaacccgtcgtcggtacaccggccaaggcccttcgacccccgttcggtcaccgttccgtccggtttcccccg

SEQ ID NO: 303547 - DNA, 531 bp, Homo sapiens
  misc_feature: GZ8MTXP02JUJR8.25.22.B11.1.454.CMB.2.raw
  modified_base (298)..(298): a, c, t, g, unknown or other
  misc_feature (298)..(298): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (520)..(520): a, c, t, g, unknown or other
  misc_feature (520)..(520): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtgctttataactatgtctcctggtcccaacaacaccaggcaacggccccaaactcatcatttangatgtcagtcatcggccctcgtggtagtttctggtcgtcttcctctggtctccaagtctggccaacgtcggccctccctgaccatccgtcggggcctccgaggctggacggacgacggcttacgttattattgactatttcatacagtagaccacaanagtctggtgtcggnggacggacagtcgaccgtctcggtcacgccaagtctcgcccctcggtacnctctcgtcccc

SEQ ID NO: 303548 - DNA, 648 bp, Homo sapiens
  misc_feature: GZ8MTXP02GAIBR.25.22.B11.1.454.CMB.2.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttgggtntacttaataactntcgtctcctcgtaccaacaacaccagacaaccgaccccaactcatactatttatgatgtctagtcacgtccggtccctcgtggtacgtttcgtcggtcgtcttcctcgtcgtctacctacgtcgtcggcctaccgtccggtccctcccgtacgacctacgttccggtccggggtccctaccgacggtcgtacggacgggacggtacggtacttaacttagttagtcgtacttattacaactaacgacgaacgaaccaaccgtaacgtaggttcgttagggtcggttacgggacgggaacgggtaaccgtacggttacggacccgttcgtacggtacgaccggacccgaacggtccgtcccgtccccgttacggtacctaccgtccgttccgttccccg

SEQ ID NO: 303549 - DNA, 574 bp, Homo sapiens
  misc_feature: GZ8MTXP02I415C.25.22.B11.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (450)..(450): a, c, t, g, unknown or other
  misc_feature (450)..(450): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccngccgtgacattggncttanaactntgtctcctggtcccaacaacacccaggcaacggcccccaaactcatcatttangatgtacagtcactcggcccctctggtatttcgtggtcgcttcctctggctcaagtcttgcaactcggcctccctgaccactcgtcgggctcgagctgagacgaggctaacttagttattgtctatttcaatacaagacgaacaacccaaanacgtctagggttcgttcgggacggaacggtacctaaaggttcgacccgtaccgtacgggtccaccggcccgaaagggtcctcccggccccctcgggtaccctaccgttccgtccgtttcccccg

SEQ ID NO: 303550 - DNA, 575 bp, Homo sapiens
  misc_feature: GZ8MTXP02IB05N.25.22.B11.1.454.CMB.2.raw
  modified_base (238)..(238): a, c, t, g, unknown or other
  misc_feature (238)..(238): n is a, c, g, or t
  modified_base (459)..(459): a, c, t, g, unknown or other
  misc_feature (459)..(459): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcggtcaccatctcctgcactggaaccagccgtgactattggtnctttaataactatgtctcctggtccaacaacacccaggcaacggcccccaaactcatcatttatgatgtcagtcatcggccctcgtggagtttctggtcgtcttcctctggtctccaagtctcggcaacgtcggccctccctgaccatctccggggctccgaggctaggaggacgacggacttacgttattattgactatttcattacagacgacaccaanagtcgtggttcgtcgggacgggacgggtaccaaggtttcgaccgttccgtacggtccgacggcccgaaggtccgtcgtcccccgtcggtaccctccgttccgttccgttccccccg

SEQ ID NO: 303551 - DNA, 633 bp, Homo sapiens
  misc_feature: GZ8MTXP02I5NZZ.25.22.B11.1.454.CMB.2.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
  modified_base (473)..(473): a, c, t, g, unknown or other
  misc_feature (473)..(473): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngcccgtgacattggtgctttaataactntcgtctcctggtacccaacaacacccaggccaacgccccaaactcatcatttangatgtcagtcacgtccggccctgtggtacgtttcgtggttcgtcttccctcgtcggtcttacccaagtcctgggcctaacgtcggccccttcctgaacccngttccgtcggggtcctacccggngcgtacggaggacgnacgtacttacttattacttattctattactanacgacgtaaccaacaacgtaactacggtacgttcgggtacggtacgggacggtacgggtaccgtaacggttaccgtaccggtccgtaccggtacccgaaccggacccgtaaccggccccgtaccggtccccgtaccggtcccgtaccgttaccctacccg

SEQ ID NO: 303552 - DNA, 528 bp, Homo sapiens
  misc_feature: GZ8MTXP02HIUXH.25.22.B11.1.454.CMB.2.raw
  modified_base (236)..(236): a, c, t, g, unknown or other
  misc_feature (236)..(236): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacagttggtnctttaataactattgtctcctggtcccaacaacacccaggcaacggcccccaaactcatcatttatgatgtcagtcatccggccctcgtggtagtttcgtggtcgtcttcctctgctcagtctgcactcgcctccctgacatcgtcgggctccgagctggagacgaggcttaacgttattatgactatttacattacagagacaccaacagtcgtggtgttcggcgaggacaagttcgaccgtcgtcgtcacgcccaaggcctcgcccctggtccacgtccgtcgtcccccg

SEQ ID NO: 303553 - DNA, 585 bp, Homo sapiens
  misc_feature: GZ8MTXP02HZTNS.25.22.B11.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagactgtacagtcacgaccggtgctcgatttagacgacagctcagggggggtctcaggaggcagcactctcgggacgtctccaccatggcctgggctctgctcctcctcagcctcctcactcagggcacaggatcccgggctcagtctgccctgactcagcctgcctccgtgtctgggactcctggacagtcggtcaccatctcctgcactggaaccagccgtgactattggtncttaanaactatgtctctgtcccaacaacaccagcaacggccccaaatcatcatttangatgtcagtcatccggcctcgtggtagtttcgtggtccgtcttctctggctccgaagttctggctaactccggaccttcccngacccatccgcgggctccgaggctggacggacgagtctacttattatgctatttcatacgagtagaccaactaacacgttcgtagggtacgttcgggacggacgggtaccgtaaacggttcggaacccggttccgtacggttaccgaaccgaaccccgtaaacggggtccctcccggcccccgttcgggtaaccctaccgtttccccgg

SEQ ID NO: 303554 - DNA, 794 bp, Homo sapiens
  misc_feature: GZ8MTXP02FKEUV.25.22.B11.1.454.CMB.2.raw
  modified_base (221)..(221): a, c, t, g, unknown or other
  misc_feature (221)..(221): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactcggaaccngccgtagactagttgggtctacttaataaacctatcgtcctcctcggtacccaaacaaccacccgaggacaaaccggacccccaaaatcatctatttatgatgtcagtcacgtccggtccctcgtaggtacgttttcgngggtcctctttcccncgttggacctaccgtaagttcgttagcccgtaactccgggtcccttcccgtacgaacctacgttcccggtccgggggtcccttacccggaacggggtccgttagggaaacggggtacgggaacgggttacctttaaacgttttatttaagttcgtaccttaacgtttttacaaactttaacgaacgttaaacggtaaaccaaacccctaaaagtacggttaccggtttagggggtttcggtttaaccggggggaccggggtaaaacgggggtaacccgttaaaagggttttcccgggaacccgttttcccggaccgggttaccgaaaacccggccccggttaaaacgggcccttaccccgggtccccccgttacggggttaccctacccggtttacccttcccggttttaacccccccc

SEQ ID NO: 303555 - DNA, 529 bp, Homo sapiens
  misc_feature: GZ8MTXP02GLJ2W.25.22.B11.1.454.CMB.2.raw
  modified_base (236)..(236): a, c, t, g, unknown or other
  misc_feature (236)..(236): n is a, c, g, or t
  modified_base (517)..(517): a, c, t, g, unknown or other
  misc_feature (517)..(517): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcggtcaccatcctcctgcactggaacccagccgtgacatttggncttaataactatgtctcctggtcccaacaacacccaggcaacggccccaaactcatcatttatgatgtcagtcatcggccctctggtagtttctggtcgtcttcctctcggtctccaagtcttgggccaactcggcctcctgaccatctcggggctccgagctggagacgaggcttaacttattattgctatttcatacagagacaccaacagtctggtgtcgggcgaggtaccaaggttcgaccgtccgtcgtacacgccgaagcctcgcccctcggccnctctctttcccc

SEQ ID NO: 303556 - DNA, 526 bp, Homo sapiens
  misc_feature: GZ8MTXP02F0DB5.25.22.B11.1.454.CMB.2.raw
  modified_base (235)..(235): a, c, t, g, unknown or other
  misc_feature (235)..(235): n is a, c, g, or t
  modified_base (436)..(436): a, c, t, g, unknown or other
  misc_feature (436)..(436): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctctgtccaacacaccagcaacgccccaaactcatcatttatgatgtcagtcatcggccctctggtagtttctggtcgtcttcctctggctcaagtctggcaactcggcctccctgaccatcgtcgggctcccgagctgagacgaggtctacgttattatgactatttcatacagtacgacaaccaanagtcgtaggtgttcggcggtaacgggaccaaggttcgaccgtccgtcggtccacgccctaaggctcgcccctcggtcactcgtcttcccc

SEQ ID NO: 303557 - DNA, 528 bp, Homo sapiens
  misc_feature: GZ8MTXP02IZI7G.25.22.B11.1.454.CMB.2.raw
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttgggtnctttaataactatcgtctcctggtcccaacaacacccagcaacgccccaaactcatcatttangatgtcagtcatcggccctctggagtttctggtcgtcttcctctggctcagtctggcaactcggcctcctgacatcncgggctccgaggctggagacgaggctacttatatgctatttcaattacagagacaacaacagtacgtggtacgttcggaggacggtacgtaagttcgaaccgtcgtcgtacacgccgaagccgtccgcccgtcgcctactcgtctccccc

SEQ ID NO: 303558 - DNA, 561 bp, Homo sapiens
  misc_feature: GZ8MTXP02I7QRJ.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccngccgtgacattggtncttataactntgtctcctggtccaacaacacccaggcaacggccccaaactcatcatttangatgtcagtcatccggccctctggtagtttctggtcgtcttcctctgctcagtctgcaactcggcctccctgaccatcctcggggctccaggctgaggacgnggctacttattattgactatttcattacagacgaaccaaccaacagtccgtagggtgttacgggacgggacgggtaaccaggtttcgacccggttcctaccggtactacggcccaaggcccgtcgacccccgtcggtcctaccgttccgtccgtttcccccg

SEQ ID NO: 303559 - DNA, 577 bp, Homo sapiens
  misc_feature: GZ8MTXP02H0BLZ.25.22.B11.1.454.CMB.2.raw
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagactgtacagtcacgaccggtgctcgatttagacgacagctcagggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcaactggaaccagccgtgacattggtgctttaanaactatcgtctcctggtcccaaacaacacccaggcaacggccccaaaatcaatcatttatgntgtcagtcatcggccctntggagtttccnggtcncttcccctntcgctacatcgtgctacgtcgcctcctgactagtccgtcggcctcgacgtcgtacggacggacgtagtacttaacgttaagttatcgtactacttactaactaacgtaacgacgaacaacgaacgacgtacgtcggttcgtcggtacggaacggacgtaacgtacgtaccgtaccgtacgtacgtacgaccgacgtcgtccgtcccgtccgtaccgtacctcgtccgtcccg

SEQ ID NO: 303560 - DNA, 597 bp, Homo sapiens
  misc_feature: GZ8MTXP02JRXW4.25.22.B11.1.454.CMB.2.raw
  modified_base (248)..(248): a, c, t, g, unknown or other
  misc_feature (248)..(248): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttaataactntgtctcctggtcccaacaacacccaggcaacggcccccaaactcatcatttatgatgtcagtcatcggccctcgtggtactttcgtggtcgtcttccgtctcgtctccgaagtctggcctaacgtccggtccctcccgtagaccctactccgtccggggtccgttaccgacggcgtcggaggacggacggtcgttacttattagttcgtctatttacatttttacgagtacgacaaccaactaagtcgtggttcgttcgggtcggacgggtacgtacggtacgtaccggtccgtacggtcgacgaccgaacgccgtccgccccgtccgtccgtcgtccgtcgttccccg

SEQ ID NO: 303561 - DNA, 534 bp, Homo sapiens
  misc_feature: GZ8MTXP02GFWCD.25.22.B11.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattgggtncttaataactntgtctcctggtcccaacaacacccaggcaacggccccaaactcatcatttangatgtcagtcatcggcccctgtggagttttcnggtcgtctttccncgtgctaccaagtctggccaactcggccttccctgacctatccgtcggggctcccgaggcctggaggacgnggcttaacgttatattgctatttcatacaganacaaccanagtctgtcgtgcggaggactagtgaccgtcgacgtcacgcctaaggctacgcccctcggtccactcgtcgttccccg

SEQ ID NO: 303562 - DNA, 701 bp, Homo sapiens
  misc_feature: GZ8MTXP02GZOKP.25.22.B11.1.454.CMB.2.raw
  modified_base (240)..(240): a, c, t, g, unknown or other
  misc_feature (240)..(240): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccagccgtgactagttgggtntacttaataactatcgtctcctacggtacccaaacaaccacccaggcaacggacccccaaactcatctatttatgtatgtcagtcacgtccgccctgtggtacgtttcgtggtcgtcttcctcgtgtctctagtcgtacgcctaacgtccggtacccttccgtacgacctacgttcccggtccggggtccttacccggacggtccgtagggaacgggtacgtacggtactttacgtttaagttacgttcgtactacgttttactaaacttaacgaacggtaacctaaacccgtaacccgtaaacgttaacggtttccggttacggggttacgggttacccggggtaacggggaaccgggttaaaccgtaaacgggttccgtaacccggttcgtaccggtacgacccgtaccgtaacgtccgtacccgccccgtacgtccctacgttccgtccgttcccccg

SEQ ID NO: 303563 - DNA, 609 bp, Homo sapiens
  misc_feature: GZ8MTXP02JXFBB.25.22.B11.1.454.CMB.2.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccagccgtgacattggtntcttataactntgtctcctgtcccaacaacacccaggcaacggacccccaactcatcatttatnatgtcagtcactccggccctcgtggtagtttcgtggtcgtcttccctctcggtctctagtctgcctaacgtccggccctccgtgacctactcgtccggggcctaccgacggctaggacggacgacggtacttacgtttattacttgacttagtttacattaacagacgtaacacctaacgtacgttcgtaggttcggttcgggacgggtaacgggtacgtaacggttcgtacccggtcgtacgggtccaccgacccgtaacggtccgtccgtcccccgtcggtcctaccgttccgttccgttaccccc

SEQ ID NO: 303564 - DNA, 681 bp, Homo sapiens
  misc_feature: GZ8MTXP02H3JF7.25.22.B11.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtnctttaataactntcgtctcctggtccaacaacaccaggcaacggccccaaactcatcatttangatgtcagtcatcggccctcgtggtagtttctggtcgtctttcctcgtcggtctaccgtaagttcgtacggctaaaccgttccggcccttccctacgacccattccgtccgggggcttcccgaggtctcgggaacgggacgtacgggtcttaaccgttaatttacgttgtacttacttttaccaagttaaccgaaggtaacgaccaaacccaaacgtaacggttccgtagggttacgggtttacgggacgggtaacggggtaaccgtaaaagggtttccgaaacccggttccgtaccgggttaccacggtaaccccgaacggggtcccgtaccggtacccccgttcgggtacctaccgtttccgttacccggtttccccccg

SEQ ID NO: 303565 - DNA, 688 bp, Homo sapiens
  misc_feature: GZ8MTXP02GCQQJ.25.22.B11.1.454.CMB.2.raw
  modified_base (322)..(322): a, c, t, g, unknown or other
  misc_feature (322)..(322): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagtttggtgtactttaataaacttattcgtctccctcggtaccccaaacaaccacccaggaccaaaccggacccccaaactcaatactatttangtatcgtacagtcacgtccggtcccttcgtggttacgtttcgtggtccgtcttcctcgtcgtctaccgtagtccgtcggcctaaccgtcccggtcccttcccgtacgtaccctacgttccgtcccgggggtcctacccggagggtcgtacggaacggtacgacggtactttaacgttattagttcgtacttaacttcaatacgaagaacgaaccaacccgaagtacgttcgtcgggttacggttccgggacgggtaacggtaccgtaaggttccgacccggttccgtacggtaccgtaaccggacccgtaacggcccgttacccgacccccgttacggtcctaccgttccgttcccgtttcccccg

SEQ ID NO: 303566 - DNA, 630 bp, Homo sapiens
  misc_feature: GZ8MTXP02H1L4L.25.22.B11.1.454.CMB.2.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagactgtacagtcacgaccggtgctcgatttagacgacagctcagggggagctctggggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggagggtccctgagactctcctgtgagtctctggattcaccatcaatgactacttatgctggatccgcaggcctcgagggagggctgggagtggattcattancagtatggaggtaatggactatttntaatccaagtacctcgtccggaggggtcccgtcgttaccacctatcctaccgaagggaccgaaccggccaaacaactacctaaacttcctttactacgactaacgtacggaaccgtacgtaccggacggacccggaacgggaccgaaccgggtccgtagttaccttccgtaggtcggacggtaggttacgggtttacgggggtttatttaggtaggtaacgttcggaccgtaggttacggttaaccttaccccgtttaacccctttaaccg

SEQ ID NO: 303567 - DNA, 661 bp, Homo sapiens
  misc_feature: GZ8MTXP02HDJ7S.25.22.B11.1.454.CMB.2.raw
  modified_base (252)..(252): a, c, t, g, unknown or other
  misc_feature (252)..(252): n is a, c, g, or t
  modified_base (319)..(319): a, c, t, g, unknown or other
  misc_feature (319)..(319): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgactagttggtgtactttaataaactntcgttcctccgtcggtacccaaacaaccaccccgaggaccaacggacccccaaactcatctatttangtatgtcagtcactccggtccctgtggtactttcgtggtctcttccctcgtcgtctccgtaagttccgtgggcctaaccgtccggccctcccgtacgaccctacgtccgtcggggcctccggaggccgtaggacggacgtacggtacttaacgtttattacgttcgtacttatttacattacgagtacgaaaccacgaacgtacgttcgtagggttcggttaccgggagggtaaccggtaacgtaaggttccgacccggttccgtacgggtaccaccggacccgtaacggtcccgtcccgacccccgttcggtaccctccgttacccgtacccgtttccccc

SEQ ID NO: 303568 - DNA, 521 bp, Homo sapiens
  misc_feature: GZ8MTXP02HUCYU.25.22.B11.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctaactcagcctgcctccgtgtctgggactcctggacagtcggtcaccatctcctgcactggaaccagccgtgacattggncttataactntgtctctgtcccaacacacccagcaacggcccccaaatcatcatttangatgtcagtcatccggccctntggtatttctggtcgcttctcctgcctcaagtctggcactcgcctcctgaccatcgtcggggctccgaggctggaggacgaggtcttacttatattgctatttcatacaganacacanagtctggtgtcggcgaggacctagtcgaccgtctcgggtacacgaccaaggcctccgcccctcggtccaccttctccgttaccccacccc

SEQ ID NO: 303569 - DNA, 654 bp, Homo sapiens
  misc_feature: GZ8MTXP02HNMJ6.25.22.B11.1.454.CMB.2.raw
  modified_base (209)..(209): a, c, t, g, unknown or other
  misc_feature (209)..(209): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctccngcactggaaccagccgtgactagttggtgtctttaataactatgtctcctcggtcccaacaacacccagcaacggacccccaaactcatctatttatgatgtcagtcatcggccctcgtgtagtttctggtcgtcttcctcgtgctccagtctggcctaacgtccggtcctccctcgtaccacgtccgtccggggcctccgacggcgtaggacgggtaacggtacgggtacttaacgtttatttacgttcgtacttacttttacaacgttaacaacggtacgaaccctaaccgtaaactacggtacgttacggggttcggttaccgggggacgggtaacgggtaccgtaaggttaccgtacccgggttacgtacggtccgaaccggaccgaacggtcccgtccggtacccccgttcggtcctaccggtccgtttcggttcccccg

SEQ ID NO: 303570 - DNA, 569 bp, Homo sapiens
  misc_feature: GZ8MTXP02GG755.25.22.B11.1.454.CMB.2.raw
  modified_base (286)..(286): a, c, t, g, unknown or other
  misc_feature (286)..(286): n is a, c, g, or t
  modified_base (508)..(508): a, c, t, g, unknown or other
  misc_feature (508)..(508): n is a, c, g, or t
  modified_base (536)..(536): a, c, t, g, unknown or other
  misc_feature (536)..(536): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggagggtccctgagactctcctgtgaagtctctggattcacatcaatgactacttanggcctggatccgcaggctccgaggggacgggctgggagtggtactttgatttatcaagtaagtggaaggtaatcggataatttataactcgaagtacctcgtaccgggagggggtccctacttccaactactccgcgacggggaacaccggaccaacaactacaacttctttcagtacaagtcgaaccgacgaccgagccgagaaccgtcgacgtgtcctgngtagcgtaggtggttaggggtacttagngaacgtgactagtcgtaactaccctaccttaac

SEQ ID NO: 303571 - DNA, 507 bp, Homo sapiens
  misc_feature: GZ8MTXP02FRC9Q.25.22.B11.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (394)..(394): a, c, t, g, unknown or other
  misc_feature (394)..(394): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggngcttataactntgtctcctggtcccaanaacacccaggccaaggcccccaaactcatcatttangatgtcagtcatccggccctntggatttctggtcncttcctctggctcaagtctggcactcgcctcctgaccatctcgggctccaggctgagacgngctacttattatgctatttcatacagagacaccacagtctggtgtcggcggagggaccaagttcgaccgtctcggcacgcccaaggctcgcccctcggtccactctcgtcccc

SEQ ID NO: 303572 - DNA, 585 bp, Homo sapiens
  misc_feature: GZ8MTXP02HJXTU.25.22.B11.1.454.CMB.2.raw
  modified_base (290)..(290): a, c, t, g, unknown or other
  misc_feature (290)..(290): n is a, c, g, or t
  modified_base (471)..(471): a, c, t, g, unknown or other
  misc_feature (471)..(471): n is a, c, g, or t
  modified_base (522)..(522): a, c, t, g, unknown or other
  misc_feature (522)..(522): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggaggcttcgtcaagcctggagggtccctgagcctctcctgtgaagtctctggattcaccatcaatgacttactttanggcctggactccgccaggctccgaggggaggggctgggagtggtatttcgatttatcagtaatgggtaaggtaatggtactaatttataaacgtccaagtactccgtccggacggggcccgtcttccacccgtatccgtccgaagggacaaccggaccaactaactaccaacttctttctnacgtaagtcgaacgaccgtccgacgccggagacgacggccgtgtactctgngcgtaggtaggttggggttattagtgtaagtgtacctaggtcgttactaccctaccgttaacc

SEQ ID NO: 303573 - DNA, 581 bp, Homo sapiens
  misc_feature: GZ8MTXP02GWI69.25.22.B11.1.454.CMB.2.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (447)..(447): a, c, t, g, unknown or other
  misc_feature (447)..(447): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcaggacacagggtcctgggcccagtctggcctgactcaacctgcctccgtgtctgggtctcctggacggtcaatcaccatttccngcactggaaccagcactgatgttgctactttgaccttgtctcttggtacacaacacccganaaagcncaaatcataatttganacagtaagcgcctntggggtttctagtcgtattcactggctcaagtctcggcaacacggcctaccctaacaatctactcgggcctccgaggtctagaacgacgagtcttgtttattcgtgtctgttgctatgtggtactagtaaaactagtttagngtacgtcggcggaagggaccctagttacgaccgttacgtaaacgtcaacgccctaaagggtcctacggtcccccttcgggtcctaaccttcccgtcgttacccccacccgttccctcgtacctcgtaactacgg

SEQ ID NO: 303574 - DNA, 574 bp, Homo sapiens
  misc_feature: GZ8MTXP02JPD75.25.22.B11.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcggtcaccatctcctgcactggaaccngccgtgacattggncttataactntcgtctctgtaccaacacaccaggcaacggccccaaactcatctatttangatgtcagtcatccggccctcgtggtacgtttcgtggtcgtcttcctcgtcggctaccgtaagtctcggcctaacgtccggtccctccgtcgacctatccgtcggggcctccgaggctcggaggacgacggtcttaacttattattgctattcaatacgagtacgacaccaacgagtcgtggtcgttacgggacggaggtaccgtagttcggtaccgtcgtacgtcgaccgtccgaacgtccgcccgccccgtacggcctaccttcgtcccgtcccccg

SEQ ID NO: 303575 - DNA, 563 bp, Homo sapiens
  misc_feature: GZ8MTXP02HT4Q0.25.22.B11.1.454.CMB.2.raw
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacagttggtgctttaataactntcgtctctcgtccaacaacaccagcaacgccccaactcatcatttangtatgtctagtcatccggccctgtggtagtttcgtggtcgtcttctctgtctcatctgcactcgcctcctcgacactcgtcgggctccgagctggacgacgaggtcttaacgtttattattcgtattactttacaattaacaggaacaccaaacaaccgtagtaccgttgggttggttcgggacggtacggtaaccgtaaggttcgaccgtccgtacgtccgacgccgagtccgtccgcccgttcggcctacctcgttcgtcccccg

SEQ ID NO: 303576 - DNA, 523 bp, Homo sapiens
  misc_feature: GZ8MTXP02FL4QV.25.22.B11.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactatttgggtntcttaataactatgtctcctggtcccaacaacacccaggcaacggcccccaaactcatcatttangatgtcagtcatccggccctntggtacgtttctggtcgtctttcctctggctcagtctgcactcgcctcctgacntctcgggctccagctgagacgaggctacgttatattgctatttcatacagagacaccaaangtctggtgtcggacggtagggacctaaggttcgaccgtcgtcggtcacgtcccaaggctcgcccctcggcactctcgtcccccg

SEQ ID NO: 303577 - DNA, 535 bp, Homo sapiens
  misc_feature: GZ8MTXP02F9MKG.25.22.B11.1.454.CMB.2.raw
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagactgtacagtcacgaccggtgctcgatttagacgacagctcagggggggtctcacgaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctcctggtcccaacaacaccaggcaaggcccccaaatcatcatttangatgtcagtcatcggccctctggtagtttctggtcgtcttcctctggctccaagtctggcaactcggcctccctgaccatccgtcggggctccgaggctgaggacgaggtcttacttattactgctatttcatanagagacaaccaanagtctggtgtcggcggaggaccaaggttcgaccgtcctacggtcacgcccgaaggcctcgaccccctcggtcaccgtcctcggttcccccg

SEQ ID NO: 303578 - DNA, 529 bp, Homo sapiens
  misc_feature: GZ8MTXP02F4T6W.25.22.B11.1.454.CMB.2.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttaataactatgtctcctggtcccaacaacacccaggccaaggcccccaaatcatcatttangatgtcagtcatcggccctntggtatttcnggtcgtcttcctctgctcaagtctggcaactcggccctcctgaccatcgtcggggctcccgagctgaggacgcggtctacttagttattgctatttcattacagaagacaaccaacagtcgtgtgttcggcggaggacctaaggttgaccgtctcggtcacgccaaggcctccgcccctcggtcctacgtctccggttcccc

SEQ ID NO: 303579 - DNA, 575 bp, Homo sapiens
  misc_feature: GZ8MTXP02GKEHC.25.22.B11.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtnacttataactntgtctcctgtccaacacaccagcaacgccccaaacncatcatttangatgtcagtcatcgccctntggtagtttctggtcgtcttcctctcgctcagtctggcaacctcggcctccctgacctatccgtccggggactccgaggctggacggacgacggtcttacttattattgactatttacattacagaacgacaaccgaactacgtcgttggtcgttcgggacggtaacgggtaccaaggtttcggacccgttccgtcggttacgacggacccgaaggccgtccggcccccgttcggtacctccgtccgttccgttacccccc

SEQ ID NO: 303580 - DNA, 780 bp, Homo sapiens
  misc_feature: GZ8MTXP02HKVXM.25.22.B11.1.454.CMB.2.raw
  modified_base (314)..(314): a, c, t, g, unknown or other
  misc_feature (314)..(314): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcacgtggaaccagccgtagactagttggtgtacttaataactattcgtctcctacggtacccaacaaccaccgagaccaaccggaccccaaatcatactatttangtatgtactagtctacgtccgtacccttgtggtacgtttcgtacggttccttcttcccgtcgtcggtccttaccgtagttcgtacggtaccctaaccgttcccggtcccttccccgtacgtacccgtacgttcccgggtcccggggtaccctcccggtaacggggtacggttacggggaaccgggtaccggtacggttacctttaaaccgtttaagtttagttccgtactttaaactttacaacgttaaacgaggtaaccgaaacccaaacgtaacgtacgttcggtacgggttacgggtaccggggtacgggtaaacgggtaacccgtaaaacggggtttccgaaccccgggttaccgtccgggttaacccacccgggaaccccggtacgggtaacccgttccccggtacccccccggttacggtacccttaacccggttcccgtttaccccgggttcccccccg

SEQ ID NO: 303581 - DNA, 635 bp, Homo sapiens
  misc_feature: GZ8MTXP02IMTW7.25.22.B11.1.454.CMB.2.raw
  modified_base (288)..(288): a, c, t, g, unknown or other
  misc_feature (288)..(288): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctggtactcctggacagtcggtcaccatctcctgcactggaaccagccgtgactagttggtgtcttaataactatcgtctcctgtacccaacaacaccagcacgccccaaacncatcatttatgatgtcagtcatcggccctcgtggagtttcgtggtcgtctttcctcgtgtctctagtctgcctaacgtccggtccctccctcgtacccatccgcgggtctccgaggcctggacggacgaggtcttacttattacgtgtacttaatttcaattacgaggtacaaccaaaccgaacgtacgttcggttcgggttacgttacgggggacgggtaacgggtaaccgtaaaacgggtttccggacccgttacccggttcgggtacccaaccggacccgtaaacggtccgtccccggcccccgttacgggtccctaccgtttcccgttaccggtttccccccg

SEQ ID NO: 303582 - DNA, 567 bp, Homo sapiens
  misc_feature: GZ8MTXP02I5O4B.25.22.B11.1.454.CMB.2.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtnacattggtncttataactntgtctctggtcccaacaacaccaggcaacggcccccaatcatcatttangatgtcagtcatcggccctntggtagtttctgtcgtcttcctctgctccagtctggctaactcggccctccctgaccagtctcggggctcccgaggctcggaggacgacggtctaacttagttacttgtactaatttccaattacaaacgagaaccaacccaaatacgttcgtgggttacgttcggggacgggtacgggtaaccaaggtttcggacccgttccgtcggtacaacgcccgaagcctccgccccgtcgtacacctctcgtccccc

SEQ ID NO: 303583 - DNA, 569 bp, Homo sapiens
  misc_feature: GZ8MTXP02JZ81X.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttaanaactatgtctctggtcccaanaacacccaggcaacggcccccaaactcatcatttangatgtcagtcatcggccctctggagtttctggtcgcttctctggctccagtctggcactcgcctcctgaccatcgtcggggctccgagcgtgaggacgaggtcttaacgttattattgcctatttcattacagtagaccaaccaacagtcgtggtgttcgggacgggaggaccgtaaagttcggaacccgttccgtacggtccacggtacccaaacggtccgtaccggtaccccccttcgggttaacccctccgtttccgtccgttccccg

SEQ ID NO: 303584 - DNA, 762 bp, Homo sapiens
  misc_feature: GZ8MTXP02JYMKG.25.22.B11.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgacttaanaactatcgtctcctggtcccaacaacacccaggacaacggacccccaaactcatcatttacngatgtcagtcagtccggccctcgtggtacgtttcgtggtcgtcttccctctcggtctacgaacgttcgtcgggtcctaaaccgttccgggtaccccttcccgtacgtaccccgtaacgttcccggttacccgggggtccttacccggtacgggaccgtttacgggaaacgggaccgggtaacgggtacctttaaaccgtttaagtttaacgtttcggtacttaagttttaccaacgttaacgacgtaaacgaaccaaacccaaacgtaacggtccgttacggggttcggtttacggggacggggttaaacggtaaacccggttaaagggttaccggtaaacccgggttacccggtccgggtttaaccgaacccgggttaccccgaaagggtcccgttccccggtaacccccgttcggggtaccctaaccggtttccgtttacccggtttccccccgg

SEQ ID NO: 303585 - DNA, 657 bp, Homo sapiens
  misc_feature: GZ8MTXP02GQBB5.25.22.B11.1.454.CMB.2.raw
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctgggaggtccctgagactctcctgtgaagtctctggattcaccatcaatgactacttanggcctggactccgcaggctccgagggaagggctgggagtggtatttgatttanctaagtagtggaaggtaactggactatttataatccagtacctcgtaccggacggggccctcgttcaccgatcctaccgaaggggaccaaccggaccaacgtaactaccaactttccttctcgaataacgtacgaaaccggtcgtaacccggacggacccggaacggaacccggaccgggtaccgttacgttaacccctttggtcggtcggaccggtaaaggttacggggttttacgggggttaacttaggtacgtaagttcggaacccgttaggtttacggtttaaaccctaaccccttacccccgtttaaaaccg

SEQ ID NO: 303586 - DNA, 580 bp, Homo sapiens
  misc_feature: GZ8MTXP02JKN30.25.22.B11.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggncttataactntgtctctggtacccaacaacacccagcaacggcccccaaatcatcatttangatgtcagtcagtcggccctgtggtacgtttctggtcgtcttccgtctggtcctccaagtcnggcaacgtcggccctcccgtgacctatccgtcggggctcccgagctggacggacgacggtcttaacgttattattcgtactatttacacttaacagacgaaccaccaaactagttccgtggttcggttacgggcgggaacgggtaacctaaggttcgacccgtcgtacgtacgacgcccgtaaggcctccggcccccgtggacctaccgtctccgttcccccg

SEQ ID NO: 303587 - DNA, 550 bp, Homo sapiens
  misc_feature: GZ8MTXP02HAMC1.25.22.B11.1.454.CMB.2.raw
  modified_base (336)..(336): a, c, t, g, unknown or other
  misc_feature (336)..(336): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (521)..(521): a, c, t, g, unknown or other
  misc_feature (521)..(521): n is a, c, g, or t
tcagactgtacagtcacgaccggtgctcgatttagacgacagctcagggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcaggtcgtgggggaggcttcgtcaagcctgggagggtcccagagactctcctgtgaagtctcgtggattcaccatcaatgactacttatggcctggactccgccaggctccgagggagggctggagtggattnatttatcagtaatggagtaatggatatttataatcagtacctcgtacggaggggccctcttccgaccatcgtacccgagggaaccaaccggccaacaataccaaacttctttctgactaagtcgaacgacgtccgacgaccggagacgacggcgtntactctggncgtagtaggttgggtaatgngaagtgcaggtgtactacctaccttaacg

SEQ ID NO: 303588 - DNA, 562 bp, Homo sapiens
  misc_feature: GZ8MTXP02JF9EI.25.22.B11.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (469)..(469): a, c, t, g, unknown or other
  misc_feature (469)..(469): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcatcatctcctgcactggaaccagccgtgactattgggtncttaataactntgtctcctggtcccaacaacaccaggcaacggcccccaaactcatcatttatgatgtcagtcatccggccctcgtggtagtttctggtcgtcctttctcgtcggtctccgaagttctgggcctaaaccgtccggcccttccctgaccctagtcccgtcggggcctccgaggcctggacggaccgaggtacttacttattagttgactatttcatacaganacaccaacagtctaggtgtcggcggtacggactaggtcgaccgtccgtcgtacacgcccgaaggcctaccgccccctggtccacttcttcccg

SEQ ID NO: 303589 - DNA, 633 bp, Homo sapiens
  misc_feature: GZ8MTXP02FIVXK.25.22.B11.1.454.CMB.2.raw
  modified_base (236)..(236): a, c, t, g, unknown or other
  misc_feature (236)..(236): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggntcttaataactatgtctcctggtcccaacaacaccaggacaacggcccccaaactcatcatttatgatgtcagtcagtccggccctgtggtacgtttcgtggtccgtctttccctcgtcggactcctaagtcttggcctaacgtccggtccctcccgtcgaccactccgtcggggtcctcccgaggtctaggaacggacgacgggtacttaactttattagttcgtacttactttacattaacgaagaacgaaccaaccaaacgacgttcgtcgggttcgttaccggggacgggtaacggggtaacctaaagggttccgaaccggttccgtaccggtacgaccgcccgtaaacggccgtccgacccccgtcggtcctaccgtccttccgttaccccc

SEQ ID NO: 303590 - DNA, 760 bp, Homo sapiens
  misc_feature: GZ8MTXP02JQPCD.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacagtcggtcacatctcctgcactggaaccagccgtgactagtttggtgtactttaataaacctattgttcctccgtcggtaccccaaacaaccaccccaaggacccaaaccggaccccccaaactcatacctattttatgtatgtcagtcactccggcccttcgtggttacgtttcgtggtcgtcttcccgtcgtcggtccttaccgtagttccgtacgggtactaaccgttccggccccctttcccgtacgaacctcgtcccgttccgggggccttacccggacggaccgtaggacggggaaccgagggtaaccttacgtttattagttcgtaccttaatttacaacgtttacgaacgtaacgaaccaaaccctaaagtcggtaaccggttagggttcggttaccggggtaacgggacggggtaacccgttaaaacggttccggtaaacccggtcccgtttaacggtacccgacccgggtacccgaaacgggttccccgacccccggttacccccgttaccgggtacccttacccggtttaccccggttcccgttttaaccccccccg

SEQ ID NO: 303591 - DNA, 677 bp, Homo sapiens
  misc_feature: GZ8MTXP02GT8U6.25.22.B11.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtnacttataactntcgtctctgtaccaacacaccaggcaacgccccaaatcatctatttangatgtcagtcagtccgccctagtggtacgtttcgtggtcgtcttccgtcgtcggtactaccgtaagttccgttgggccctaaccgttccgggtcccccttaccccgtacgtaaccctacgttcccgggtcccggggtcccgttacccggacgggtccgttacgggaacgggtaacccggtagggttacctttaacgtttaacgtttacttacggtacttaactttactaagttaccgaagtaacgtaaccaaacccaacgtacgttcgttacgggtcggttacgggacggacggtaacgtacggtacgtacccggttcgtacggtcgaccgtccgaacgtccgtcgtaccccgtcggtcctacgttccgtcgttcccccg

SEQ ID NO: 303592 - DNA, 650 bp, Homo sapiens
  misc_feature: GZ8MTXP02JCBZO.25.22.B11.1.454.CMB.2.raw
  modified_base (371)..(371): a, c, t, g, unknown or other
  misc_feature (371)..(371): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggtttccttgttgctcttgtaaaaggtgtccattgtcaggtgcaggttggtgcaggtcgtgggggagcttcgtcaagcctgggagggtccctgagctctcctgtgagtctctggattcacctatcaatgactacttatggcctggactccgcctaggctacgaggggacggctagggaggtggtactttctaatttacgtcaagttaagtggaagttaagnggacttatttagaactacagtactcgtccgggacgggtcccgtccttacaccactccaccgaggggaccaaccggaccaaactactacctaaacttctttacgacgtacctaaggtaccgaaccggtaccgacccgaacggacccggtaacggaccaaccgggtccgtaacgtccgtttaccgtggttacggaccgtagggtagggtttacgggggtttaacttggtataaggtcgttaccgtaggttacgttaccttaaccccgttaccttaaacccg

SEQ ID NO: 303593 - DNA, 524 bp, Homo sapiens
  misc_feature: GZ8MTXP02FG1GF.25.22.B11.1.454.CMB.2.raw
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccagccgtgacattggncttataactatgtctcctgtcccaacaacacccaggcaaggcccccaaactcatcatttangatgtcagtcatcggccctctggtagtttcnggtcgcttcctctgctccaagtctggcaactcggcctccctgaccactcgtcggggctccagctgagcgaggctagtattattgctattcatacagaagacaaccaacagtactggtgtacggtcggacggacgtaagtgaccgtcgtacggtcacgccaacggcgtcgtcccccgtcggtccactcctcgttcccccg

SEQ ID NO: 303594 - DNA, 557 bp, Homo sapiens
  misc_feature: GZ8MTXP02I4FCY.25.22.B11.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (445)..(445): a, c, t, g, unknown or other
  misc_feature (445)..(445): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactntgtctcctggtcccaacacaccaggcaacgcccccaaactcatcatttangatgtcagtcatcggccctntggtagtttctggtcgtcttctctcgctccaagttcnggcaactcggcctccctcgactactcgtcggggcttcccaggctaggacggacgacggtcttacttattacttgcttatttcattacaggtanacaccaatacggtctgggtgttcgggacggtagggtacctaggttacgaccggttcgtacggtcacggtacccaaacggctcggcccctcggactacctcgtcgtttccccc

SEQ ID NO: 303595 - DNA, 581 bp, Homo sapiens
  misc_feature: GZ8MTXP02GRHAO.25.22.B11.1.454.CMB.2.raw
  modified_base (234)..(234): a, c, t, g, unknown or other
  misc_feature (234)..(234): n is a, c, g, or t
  modified_base (436)..(436): a, c, t, g, unknown or other
  misc_feature (436)..(436): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttaataactatgtctcctggtcccaacaacacccaggcaacggcccccaaactcatcatttatgatgcagtcatcggccctcgtggtagtttcgtggtcgtcttcctctgctcaagtctggcaactcggcctccctgaccatccgtcgggctccgaggctgagacgaggactacgttattatgtactatttcaattacganaacgacaaccaacgagttacgtgggttgttacgggacggtaacgggtaacctaacggttcgaacccggttccgtacggtaccgacgtccccgaaacggccgtaccgtcccccgtcggtcctaccgtccgttaccgtttacccccc

SEQ ID NO: 303596 - DNA, 600 bp, Homo sapiens
  misc_feature: GZ8MTXP02J2Y8S.25.22.B11.1.454.CMB.2.raw
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcaggtcgtgggggaggcttcgtcaagcctgggacgggtccctgagactctcctgtgaagtctctggattcaccatcaatgactactttatggcctggactccgcaggctccggagggagggctgggagtggatttcgatttanctagtaagtggaagtatggctatttanaatccagactcgtccggacgggccncgttacaccatcctccgacggacaaccggaccaacaactacctaacttccttactcgacgtaagtacgaacggaccgtaccgacggaccggaacgggaccgaccggtaccgtacggtacctttcgtaggttcgacggtagtacgggttacgggggttattaggtgaagtcgtaccgtagtacgttactaccctaccttaaccg

SEQ ID NO: 303597 - DNA, 620 bp, Homo sapiens
  misc_feature: GZ8MTXP02J1WUI.25.22.B11.1.454.CMB.2.raw
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (459)..(459): a, c, t, g, unknown or other
  misc_feature (459)..(459): n is a, c, g, or t
tcagactgtacagtcacgaccggtgctcgatttagacgacagctcagggggagctctgggagaagagccccagccccagagttcccaggagtttccattcggtgatcagcactgaacacagaggactcactatggagtttgggctgagctgggttttccttgttgctcttgtaaaaggtgtccattgtcaggtgcagttggtgcagtcgtgggggaggtcttcgtcaagcctgggacgggtccctgacgactctcctgtgagtctctggattcaccatcaatgacttactttatggcctggactccgcaggctccgaggggagggctgggagtggtatttcatttancgtaagtatgggaagtaatggactatttanactcagactcgtcggagggcccncttaccacctactcctaccgagggaccaaccggaccaacaactaccaacttcctttacncgacagtacgaacggaccgtccgacgtaccggacggaccgaccgggtcgtacgtacgtttccgtggtcggcggtaagggttaggggtttagggggttactttagtaggtaagtcggtacccgtaggtttacggtttaacctaaccccgttacccttaaccg

SEQ ID NO: 303598 - DNA, 607 bp, Homo sapiens
  misc_feature: GZ8MTXP02HFKC4.25.22.B11.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccagccgtgactagttggtnactttaataactatcgtctcctggtacccaacaacacccaggcaacggcccccaaactcatcatttatgatntcagtcagtcgccctctggtactttcgtgtcgtcttcctctgctcagtctgccaactcggaccctcctgaccacgtccgtccggggccttcccgaggcgtaggacggtacgacgggtcttaacgtttattacttgtactactttacaacgttacagacgtaacaaccaacgtacgtcgtacggttggttcgggacggacggtaaccgtaagttcggaccgtccgtacggtacacgacccgaacggtcctcccggtacccccttcgggtaccctccgttccgttaccgtttcccccc

SEQ ID NO: 303599 - DNA, 575 bp, Homo sapiens
  misc_feature: GZ8MTXP02FF9RW.25.22.B11.1.454.CMB.2.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (474)..(474): a, c, t, g, unknown or other
  misc_feature (474)..(474): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactatttggngtcttaataactntgtctcctggtccccaacaacacccagcaacggcccccaaactcatcatttatgatgtcagtcatccggccctntggtatttccgnggtcgtcttcctctggtctctaacgtcttgggccaaccgtcggcctcccctgaccactcgttcggggctccgagtcctggagacgaggtcttaacttattattgactatttaccattaacgagagaaccaacccaaaacngtaacgtggtcggttcggcggacggaccaagttcgaaccgtccgtcggaccacgcccgaaacggcctcgccccccgtcggtcctactctcgtttacccccc

SEQ ID NO: 303600 - DNA, 623 bp, Homo sapiens
  misc_feature: GZ8MTXP02HERVR.25.22.B11.1.454.CMB.2.raw
  modified_base (474)..(474): a, c, t, g, unknown or other
  misc_feature (474)..(474): n is a, c, g, or t
tcagactgtacagtcacgaccggtgctcgatttagacgacagctcaggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcaggtcgtgggggagtcttcgtcaagccgtggagggtccctgagactctcctgtgaagtctctggattcaccatcaatgacttacttatggcctgactccgcaggctccgagggagggctgggagtggtattcatttatacgagtaagtgggtaaggtatggtacttaagtttataactcaagtacctccgtacggacggggccctcgttaccaccctatcccgtacgaacgggaccaaccggccaaactaactacctaactttctttacgnacgtaagtacgaaccggtaccgacccggacggacccggaaggaccgtaccgggaccgttagtccgttacgtggtcgtacgggtaggtcgggtttaggggtattgtagtaagtcgaccgtaggttacgtacctaccccgttacctaaccg

SEQ ID NO: 303601 - DNA, 705 bp, Homo sapiens
  misc_feature: GZ8MTXP02J4MB2.25.22.B11.1.454.CMB.2.raw
  modified_base (236)..(236): a, c, t, g, unknown or other
  misc_feature (236)..(236): n is a, c, g, or t
  modified_base (246)..(247): a, c, t, g, unknown or other
  misc_feature (246)..(247): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (425)..(425): a, c, t, g, unknown or other
  misc_feature (425)..(425): n is a, c, g, or t
tcagactgtacagtcacgaccggtgctcgatttagacgacagctcaggggggttctcaggaggcagcgctctcgggacgtctccaccatggcctgggctctgctgttcctcaccctcctcactcagggcacagggtcctgggccccagtctgccctgactcagcctgcctccgtgtctgggactcctggacagtcggtcaccatctcctgcactggaaccagccgtgacattggtncttataactnnttcncctgtccacaacaccacgcaacgtaccccgacctaacnctactatttagttagtatgtctagtcgaatccgtcccggtccgttcggttcggttagtttccgtggttcttccccttcttcgtcgaacttctaacggttcgtcgaaccgtaccgtccccggtccgtttaacccccncgtaccgtcggttcggtccggtactccgggaggtcgaaggtaacgggaacgtacgttacttttacttaatttacttcgacttttacttacaacggttaacaacggacaacccaaaccgttaacgtacgttacgggttgggtttcggggttaccggggacggggttaccgaacggttaacgtacggttaacccggtcccgtttaccgtacgtcccgaacccggtcccgtacgtcccccggttaccggtccccgttcccgttaacccgttcccgtttcccgg

SEQ ID NO: 303602 - DNA, 638 bp, Homo sapiens
  misc_feature: GZ8MTXP02IKV6X.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtnctttaataactntgtctcctggtacccaacaacaccaggccaacggacccccaaactcatcatttangatgtcagtcatccggccctgtggtacgtttcgtggtcgtctttcctcgtggtctaccagttcctggcctaacgtccggcccttcccgtacgacctacgttccgtaccggggtctcccgaggtctaggaacgggtacgacggtacttaacgtttattattcgtacttaattttcaacgttaacgagtaacgaacctaacctaaacgtacgttcgttcgggtacgttacgggacgggaacgggtaacccgtaggttccggaccgttccgtcgtaccgacgtacccgaggtccgtccgcccccgttacgcctaccgttccgttaccgttaccccc

SEQ ID NO: 303603 - DNA, 727 bp, Homo sapiens
  misc_feature: GZ8MTXP02JDJIP.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
tcagactgtacagtcacgaccggtgctcgatttagacgacagctcgagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttaataactntgtctcctggtcccaanacacccaggcaacggcccccaaactcatccatttangatgtcagtcacgtccgcctgtggtactttcgtcggtcgtcttccgtacgtcgtacctaccgtaagttccgacgggtcctaaccgttcccggtccccttacccgtacgtaccctacgttcccggtaccgggggtcctacccgtacggtcgtacgggaacggacggtacggttacttaacgtttaacttagttcgtacttaacgtttacaacgttaacgaacgtaacgtaaccgaaaccgtaaacgtaacggttacgttacgggttcgggttaccggggacggggtaaacgggtaaccgttaaacggttaccggtacccggttaccggttaccggtaccgtaaccggtacccggtaaacgggtcccgttacccggtacccccggttaccggtaccctaccgtttcccgttacccggtttaacccccg

SEQ ID NO: 303604 - DNA, 597 bp, Homo sapiens
  misc_feature: GZ8MTXP02JHCQ8.25.22.B11.1.454.CMB.2.raw
  modified_base (286)..(286): a, c, t, g, unknown or other
  misc_feature (286)..(286): n is a, c, g, or t
  modified_base (336)..(336): a, c, t, g, unknown or other
  misc_feature (336)..(336): n is a, c, g, or t
  modified_base (521)..(521): a, c, t, g, unknown or other
  misc_feature (521)..(521): n is a, c, g, or t
tcagactgtacagtcacgaccggtgctcgatttagacgacagctcaggggagctctgggagaagagccccagccccagagttcccaggattttccattcggtgatcagcactgaacacagaggactcaccatggagtttgggctgagctgggttttccttgttgctcttgtaaaaggtgtccattgtcaggtgcagttggtgcaggtcgtgggggaggcttcgtcaagcctgggaggtccctgagactctcctgtgagtctctggatcacatcaatgactacttangcctggactccgcaggctcgaggggagggctagggagtggtattcattancagtaatcggaagtaatggactattataactccaagtacctcgtaccggaggggtccctcttccgacctatcccgtacgaacggggaaaccaccggaccaaactaactactaaaccttctttccagactaaggtacaacggtacgaccgagacccggaaggaccacgggtccctggtaccttcgngtcggcgtaaggtacgggtttggggttactagtggaacttcggacgttagtcggttactacccgtacccttaaacg

SEQ ID NO: 303605 - DNA, 572 bp, Homo sapiens
  misc_feature: GZ8MTXP02FUGOM.25.22.B11.1.454.CMB.2.raw
  modified_base (237)..(237): a, c, t, g, unknown or other
  misc_feature (237)..(237): n is a, c, g, or t
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtntcttaataacttatgtctccgtcgtacccaaacaacaccaggcaacgccccaaactcatcatttangatgtcagtcacgtccggccctgtggtacgtttctggtccgtcttcctcgtcgctacagtcngcactccgcctcccnacatcgtcgggctcgngctgaggacgacgtacttacgttattatcgtacttattcctaatacgagaacgaacaacccaatagtcgttagggtcggttacgggacgggtaacggaccgtaagttcggaccgtccgtacgtcgacgccgaacggtccgtccgccccgttcggtcctaccgtcgtccgtcccccg

SEQ ID NO: 303606 - DNA, 711 bp, Homo sapiens
  misc_feature: GZ8MTXP02H0SRX.25.22.B11.1.454.CMB.2.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactctggacagtcgtcaccntctcctgcactggaaccagccgtagacagttgggtgtactttaataacctatcgttctcctcggtacccaaacaaccacccaggaccaaccggacccccaaacncatactatttactgtatgtactagtccatccgccctgttggtacgtttcgtggtcgtcttcctctcggtctacctagtcgtacggtctaaccgtccgtcccctcccgttaccggacctacgtcccgggtccggggtcctacccggtacggtccgttagggaaccgggtacgacggttactttaacgtttatttacgttcgtacttatttaccaatacgtaacgagaacccaaccgtaacgacggtttcgtagggttacgggttacccggggacgggtaaaccggggtaacttaaaacgggtttccgaacccggtttccggtcgggttaccgaccggaacccgtacggtcccggtcccgtaccccgttccgggttcctacccggtttcctttacccggtttcccccc

SEQ ID NO: 303607 - DNA, 531 bp, Homo sapiens
  misc_feature: GZ8MTXP02GD117.25.22.B11.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaacggcccccaaactcatcatttangatgtcagtcatcggccctntggtatttcgtggtcgtcttcctctggctccaagtctggcaactcggcctcctgacntcgcgggctccagctgagacgagtctacttatattgctatttcatacagagacaaccaanagtcgtggtgttcggngggtacggaactaggttgacccgtccgtcggtacacgcccaaggcctcgccccctggtcctaccgttctcgttcccccg

SEQ ID NO: 303608 - DNA, 582 bp, Homo sapiens
  misc_feature: GZ8MTXP02GDWT2.25.22.B11.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtnctttataactatcgtctcctggtcccaacaacacccaggcaacggcccccaaactcactcatttangatgtcagtcatcggccctntggtagtttctaatcgcttcctctgctccaagtcnggtcagcaccggcctccctgacatctcgtggctcaggctgacggacgaggctagtattactactgacttactcaacttatacggactacattacaacctaaattccccgttcttaccgggtaaccttcgggggaaccctaacgggggttcccaacccggttccgtgggggttacccaacggcccccgaaagggaccccctaaaacccggctaacggtcttaacccg

SEQ ID NO: 303609 - DNA, 763 bp, Homo sapiens
  misc_feature: GZ8MTXP02GHIM4.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtagactagtttggtgtactttaataaaccttattcgttcttcccgtacggttaccccaaaccaaacccaccccaagggaccaaaccggacccccccaaaactccaacttacctaattttaatcggtaattcgtacaaggtctacgtccggcccttcgtggttacgtttcgtcggtcgtcctttcctcgtcggtccttccgtaagtccgtggcctaaccgtccggtacccctcccgtcgtaccctacgttcccggtccggggtcccttacccggaagggtccgttacgggaaacgggtaccggtaacgggtacctttaaaccgttttaagtttagtttcggtaaccttaactttttacaacgtttaaacacggtaaaaccgtacccaaaccctaaaacgtcgtccggtttagggtcggttaccgggacgggtaacgggtaacctaaggttccgaaccgttccgtaccggtaccgacggaccccgtaggtcccgtcccggccccgttaccggtcctccgtttccgtcccggtttccccccg

SEQ ID NO: 303610 - DNA, 662 bp, Homo sapiens
  misc_feature: GZ8MTXP02H6IW6.25.22.B11.1.454.CMB.2.raw
  modified_base (192)..(192): a, c, t, g, unknown or other
  misc_feature (192)..(192): n is a, c, g, or t
  modified_base (207)..(208): a, c, t, g, unknown or other
  misc_feature (207)..(208): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcacatctccnncactggaaccngccgtgactagttggtnctttaataactntcgtctcctcgtacccaacaaccacccaggaccaacggacccccaaactcatactatttangatntcatcagtccgcctgtggtattcgtggtctcttcctgtcgtctctagtctcggctaaccgtcggaccccttccgtacgaccctacgttcccgtaccgggggtcctaccggtacggtccgtagggaacgggtaaaccggtacgggtacctttacgtttaaatttcgttacgtatttacgtttacctattaaaccgaagaacaaccaaacctaaagtcgttcgtacgggttacggtagggtacggtaaacggggtacctaagggttccgaaccggttccgtaccggtccgaccgtacccgacggtccgtacccgtccccgtacgtcgtacccttcgttacccgttcccccg

SEQ ID NO: 303611 - DNA, 690 bp, Homo sapiens
  misc_feature: GZ8MTXP02GLMY8.25.22.B11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacngtcggtcaccatctcctgcactggaaccngccgtgacattggncttaataactatcgtctcctgtcccaacaaccaccaggcaacggaccccaaactcatctatttatgatgtcagtcagtccgcccttcgtggtacgtttcgtggtcgtcttcctcgtcggtcctacctaagtcgtcgggccaaccgtccggtccctccctcgaccctcgttcccggtcggggtcctccgaggtccgtagggaacggacgacggtacttaccgttagttattcgtacttactttactaacgttaacgtagaaccgtaaccaaaccctaaacgtacggttaccgttggggttacggttccggggaacggggaccgggtaacgtaacgggtttccggaacccgggttccccgtttacgggtaccgaaccggtaccccggtaacggcccgtccccggtaccccccgtacggggttcctaaccccgtttccggttccccggtttcccccccg

SEQ ID NO: 303612 - DNA, 678 bp, Homo sapiens
  misc_feature: GZ8MTXP02HDS76.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtncttanaactntcgtctctgtacccaacacaccagacaacgcccccaaactcatctatttangtatgtacagtcacgtccgccctgtggtattcgtggtcgtcttccgtcgtgctcgtaagtcgtacggcctacgtccggcccttccctacggtacccctacggttcccggtccgggggcccttacccggagggtaccgttacgggaaacgggaaccggtacgggtacctttaaacgtttaagtttactcggttaacttacttttacgaacttaacgagaacgaacctaaccaacgtagttcgtaggtcggttacgggacgggtacggtaactaacgggttcgtacccggttccgtacggtaccgaccggacccgtaacgggtcccgtcccggtaacccccgttacggttcccaccgtttcccgttacccggttccccccg

SEQ ID NO: 303613 - DNA, 750 bp, Homo sapiens
  misc_feature: GZ8MTXP02I0SMQ.25.22.B11.1.454.CMB.2.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtntactttaataactagtcgtctccgtcggtacccaacaaccacccaggacaacggacccccaaactcactctatttangatgtcagtcacgtccggtccctcgtggtacgtttcgtcggtctcttccgtcgtcgtcctaccgtaagttcgttacggcctaaccgttcccggtaccctcccgtagaccctagttcccggtccggggtcctaccgacgggtcgtagggaacgggtacgtacggtactttaacgttatttacgtactacttaaattttaccaatttaaccgaaaggtacgtaaaacccaaaccccgtaaaggtacggttaccgtagggggttccggttaccggggaaacggggtaacgggttaaaccccgtaaagggttttcccggaaacccggttaccggttccggttaacgaacccggtacccgtaaagggggtcccccttacccgggtacccccccgttaggtcccccggtaacctttccggtttaccccggtttcccccccg

SEQ ID NO: 303614 - DNA, 569 bp, Homo sapiens
  misc_feature: GZ8MTXP02JRXHK.25.22.B11.1.454.CMB.2.raw
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (430)..(430): a, c, t, g, unknown or other
  misc_feature (430)..(430): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtnacttataactatgtctctgtccaacacaccagcacgcccaaancatcattangatgtcagtcatcggccctagtcggtagtttctggtctcttccctctggctaccgtaagtcgtgcctaactccggccctcccgtgacctatcgtccggggcctccgaggcgtgacggacgaggacttaacttagttacttntactattacaatacgagaacaacaacaacgtcgtcgtggtcggtacggacggacggtaacgtaggtaccgaccgtcgtacgtacgaccgaccgtacggccgtcccgtacccgtcgtacctacccgttcgtcccgtaccc

SEQ ID NO: 303615 - DNA, 685 bp, Homo sapiens
  misc_feature: GZ8MTXP02HEMU0.25.22.B11.1.454.CMB.2.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgactattgggtntcttaataactntcgtctctcgtacccaacaaccaccaggacaacggacccccaaactcatctatttatgtatgtcagtcatccggccctgtggtacgtttcgtggtcgtcttcctcgtcggtctcgtaagtctggctaaccgtccggtccctcccgtagtaccgtacgtccgttccggggccttacccgaggtccgtagggacggtaacgtacggtacttaacgtttatttacgttacgtacttaactttacgaacttacgaacgtaacgtaaccaaacctaaacgtacgttaccgttggggttccggttaccggggacgggtaacgggtaaccgttaaacgggttccggtaaacccggttcggtaccggttaccgaccggacccgtaacggtccgtaccccggtccccgttacgggtccctaccgttcccgttcggtttccccccg

SEQ ID NO: 303616 - DNA, 552 bp, Homo sapiens
  misc_feature: GZ8MTXP02GGA0D.25.22.B11.1.454.CMB.2.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (330)..(330): a, c, t, g, unknown or other
  misc_feature (330)..(330): n is a, c, g, or t
  modified_base (408)..(408): a, c, t, g, unknown or other
  misc_feature (408)..(408): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcggtcaccatctcctgcactgggaaccagccgtgactattggtncttataactntgtctcctgtacccaacaacaccagcaacggcccccaaatcatcatttangatgtcatcatccgccctgtggtagtttcgngtcgtcttctctcgctacagtctggcctacgtccggcctccctgacctatcccgtcgggctcccaggctggagacggngtacttaactttattatgctattcaatactaggactaacacccaatgtacgtgtcgttacgggacggtaacggactagttaccggacctcgtacgtaccgacgaccgtaagcccgtcgcccccgtagcctactccgtcgttccc

SEQ ID NO: 303617 - DNA, 657 bp, Homo sapiens
  misc_feature: GZ8MTXP02HGM6E.25.22.B11.1.454.CMB.2.raw
  modified_base (292)..(292): a, c, t, g, unknown or other
  misc_feature (292)..(292): n is a, c, g, or t
tcagactgtacagtcacgaccggtgctcgatttagacgacagctcagggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcaggtcgtgggggagcttgtcaagcctgggagggtccctgagtactctcctgtgaagtctctggattcacatcaatgacttactttagnggcctggactcccgccgaggcctcgaggggaaggggctgggagtggatttcatttatcgaggtaatggggaagtaatgggtactatttataaactctaacggcttccgtacccggggaacggggtcccgtcgttccaaaccctattcccgtaccgaacgggggaaccaaacccgggacccaacctaaaactccctaaacttctttaccctggacctaaaggtcgaaccggacgtccgacgccggaacggaccgaaccggtccgttagtacctttcgtcggtcgacgggtagttagggtttcgggggttaattcggtagtaagtcgacgtacggttacggtttacctaccccttacccgttaaacg

SEQ ID NO: 303618 - DNA, 603 bp, Homo sapiens
  misc_feature: GZ8MTXP02HRRSJ.25.22.B11.1.454.CMB.2.raw
  modified_base (236)..(236): a, c, t, g, unknown or other
  misc_feature (236)..(236): n is a, c, g, or t
  modified_base (315)..(315): a, c, t, g, unknown or other
  misc_feature (315)..(315): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccacctcctgcactggaaccagccgtgacattggtncttaataactatgtctctcggtcccaacaacacccagcaacgccccaaatcatcatttatgatgtcagtcatcggcctntggtatttctgtcgtcttctctggctcagtctggcactcgccctcctcgaccatcgtcggggcctccgaggcgtacggaggacgacggtccttaactttattattcgcttatttcaattacgaagtacgaaccaaccaaagacgttcgtgggttcgttacgggacgggaacgggtacctaaacggttcggacccgttcccgtacggtaccgacggaccccgtaaacgggcccttccggccccccgttacgggtccctaaccttccgttcccgtttccccggtcccccg

SEQ ID NO: 303619 - DNA, 562 bp, Homo sapiens
  misc_feature: GZ8MTXP02IC4XG.25.22.B11.1.454.CMB.2.raw
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtccggtcaccatctcctgcactggaaccagccgtgactattgggtnctttanaacttntcgtctcctggtacccaacacacccaggaccaacggacccccaaactcatcagtttangatgtcagtcatccggccctctggtacgtttctggtcctcttctctggctcaagttcnggccacgtcggcctccctgacatcgtcggggctcgaggctggaggacaggtctactttagtacttgtactnttcatacaaggtcaaaccaaccgagagttccgtgggtgttcgggacggaggaacgtagtcgaccgtcgtcggtcaacgcccgtagccgtacgtccccctcggacctcgttccgtccttaccccc

SEQ ID NO: 303620 - DNA, 704 bp, Homo sapiens
  misc_feature: GZ8MTXP02HQ419.25.22.B11.1.454.CMB.2.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacaggtcggtcaccatcctcctgcatggaaccngccgtgactattggtnctttaanaacttntcgtctctcgtaccaacaaccaccagacaacgaccccaaancatctatttnatatgtcagtcacgtccgtcctgtggtacgtttcgtggtctcttccgtcgtcgtctacctagttcgtagcctaccgtccgtccctcccgtacgacctacgttccggccgggtcctccgacggcgtacggacggtacgtacggtactttaacgtttacttagttcgtacttactttacgtaacgtaacgaacggtaacgaacctaaaccgtaaacgtacggttacggttacggggttacgggttaccgggggacggggtaacggggtaaccgttaacgggttaccggtaacccggtttaccggtaccggtaccgtaacccgggtaccccgtaacgggccccgttaccccggtacccccgttaccggtacccttcccggtttacccgttccccggttcccccg

SEQ ID NO: 303621 - DNA, 616 bp, Homo sapiens
  misc_feature: GZ8MTXP02JXS1N.25.22.B11.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggncttataactatgtctctgtccaacacaccagcaacgaccccaacncatacatttancgatgtnagtcagtccggcctcgtgtagtttcgtggtccgtcttccctcgtcgtcttaccaagtcttacggacctaacgtccggtccctccgtacgaccctacgtccgtccggggtcctaccgacgtcgtcggacggacgacggtacttaacgtttattacttacgcttaactttacaacgttacgaacgagaacccaactaaacgtacgttacgtggtaggttccgggacgggtaacggtacgtaacggtcgtaacccggttccgtcggtaccacgacccgaacgccgtcccgtcccgtcgtacctaccttcgtcccttaacccc

SEQ ID NO: 303622 - DNA, 541 bp, Homo sapiens
  misc_feature: GZ8MTXP02FHYKH.25.22.B11.1.454.CMB.2.raw
  modified_base (233)..(233): a, c, t, g, unknown or other
  misc_feature (233)..(233): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggngcttataactatgtctcctggtacccaacaacacccaggcaaacggcccccaaactcatcatttatgatgtcagtcatcggccctntggtatttcnggtcgtcttcctctggctccaagtctggcaacgtcgcctccctgacactcgtcggggctccgaggctgaggacgaggtctaacttattattgacattcatacagacgacaccaacagtctggtgttcggcgggaaggacctaaaggttcaaccgtcctacggtcaacgcccaaggcctacggcccccttacggcctacctctcgttaccccc

SEQ ID NO: 303623 - DNA, 655 bp, Homo sapiens
  misc_feature: GZ8MTXP02JTQOV.25.22.B11.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacagttggtnacttaataactatcgtctcctgtcccaacacaccagcaacgccccaactcatcatttatgatgtcagtctacgtccggtccctcgttggtacgtttcgttggtccgtcttccgtctcgtctccagtcgtcgcctaaccgtccggcccttccctcgacctcgtccgtccggggtcctccgacggcgtagggacggacggtacggtacttaacgttactttacgttcgactttactttactaacttaccgtaaggacggtaaaccaaaccctaaacgtcgttacggttaggtcgggtttaccggggacgggtaacgggtaacctacggttcgacccggttcgtccggtaccgaaccggacccgtaacggtcccgtcccgtaccccgttccggtacctacccgttccgttaccgttccccc

SEQ ID NO: 303624 - DNA, 626 bp, Homo sapiens
  misc_feature: GZ8MTXP02HMA4W.25.22.B11.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtagactagttggngtcttaataactatgtctcctgtccaacaacaccagcaacgccccaactcatcatttangtatgtcagtcacgtccggcccttcgtggtagtttcgtggtcgtcttcctctgtctcagtctgctactcgcctcctgacagtcgtcgggctccgagtcgtggacggacgtacggtcttaacgttattatcgtattactttacaacttacgaagacgaaacctaaccgaaacgtagttacgttaggggttcggttacggggacggggtaacgggtaaccgtaaacggttcggtaacccggttccgttacggtaccgtaaccggaccccgtaaacggtcccgttccggtacccccggttcggtacctcccgttccgtttccgttacccccc

SEQ ID NO: 303625 - DNA, 764 bp, Homo sapiens
  misc_feature: GZ8MTXP02H5DBW.25.22.B11.1.454.CMB.2.raw
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtagactagttggtanctttaataacttatcgtctcctcggtaccaacaacaccaggacaacggacccccaaactcatactatttangtatgtacagtcagtccgccctcgtggtacgtttcgtggtcgtcttcctcgtcgtctcgtaagttcgtcgtctaaaccgtcgtcccttcccgtacaccgtacttccggtccggggccttccgaacggtctacggagggaacgacgggtaccttaacgtttacgtttagtttacgtactttaactttacgtaaacgtttaacgaaaggttaacggtaacccaaaccgtaaaaccgtaacggtttaccggtacggggtttccgggtttaaccgggggacccgggggtaaaacggggtaaccggtaaaacgggtttacggtaaccccggtttacccggttaccggggttaccgaacccgggttaaccccgaaacgggtcccgtacccccgggttacccccgttacccggttcccgttaaaccccgttcccgtttaaccccggtttacccccccccg

SEQ ID NO: 303626 - DNA, 637 bp, Homo sapiens
  misc_feature: GZ8MTXP02I20AS.25.22.B11.1.454.CMB.2.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtgcttaataactntgtctcctggtcccaacacaccagcaacgccccaaatcatcatttangatgtccagtcacgtccggccctcgtggtacgtttcgtcggtcgtcttcctcgtcggctaccctaagtcctggctaaccgtccggcccttccctcgacccagtccgtcggggccttcccgagggtccgtaggacggacggacggtaccttaacgtttattacgttgtaccttaattttcaacgtttaccgaggaacgtaaccaaccctaaacgtcgttacggttgggttcggttcgggacgggtaacgggtaccgtaaggtttccggacccgttccgtcggtacacgcccgtaaggccgtaccgtcccccgttcggtcctaccgttccgttccgttcccccg

SEQ ID NO: 303627 - DNA, 752 bp, Homo sapiens
  misc_feature: GZ8MTXP02HS3GJ.25.22.B11.1.454.CMB.2.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgcttaataactatcgtctcctcggtcccaacaacaccaggccaacggacccccaaactcatctatttatcgatgtcagtcactcggcccttcgtggtagtttcgtcggttcgtccgtttccctcgtcggtcctaccgtaagttccgtggcctaaacgttccggtcccttccccgtagtaacccctagttcccgtccgggggtcctcccgtacgggcgtcgggaacggacggtacggtcttaacgtttatttacgttacgtacttacttttacaaacgtttaaacgacgggtaactaaacccaactaaaaccgtacgttccgttacggggttcggtttaccgggggacgggtaaaccggggtaaccgttaaaacgggtttccgggtaaaccccggtttcccggttaaaccgggttcccgtaaaccggaccccggtaaaacgggtccccgtcccgggacccccccgttttcggggacccctttaacccgttcccgtttcccggtttaaccccccccg

SEQ ID NO: 303628 - DNA, 513 bp, Homo sapiens
  misc_feature: GZ8MTXP02FISPE.25.22.B11.1.454.CMB.2.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggcccccaaatcatcatttangatgtcagtcatcggccctntggtatttcnggtcgtcttcctctggctcaagtcnggcaactcggcctccctgaccatctcggggctccaggctgagcgagctacgttntactgctatttcatacagagacacaangtctggnttgggcgaggaccaagttcgaccgtctcggtcacgccaaagccgtcgcccccgtggccacgtcctcgttcccccg

SEQ ID NO: 303629 - DNA, 738 bp, Homo sapiens
  misc_feature: GZ8MTXP02IRSHR.25.22.B11.1.454.CMB.2.raw
  modified_base (322)..(322): a, c, t, g, unknown or other
  misc_feature (322)..(322): n is a, c, g, or t
tcagactgtacagtcacgaccggtgctcgatttagacgacagctcaggggggggtctcaggaggcagtgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgtactttaataacttatcgttctccgtcggtacccaaacaaccacccgaggaccaaccggacccccaaaactcactactatttangtatgtcagtctactccggccctgtggttacgtttctggtcgtcttccgtctcggacctacgtagttcgtcggacctaccgtccggtccctcccgtcgtacctcgtccggtcggggcctaccgaacgcgtaggaacgggtacgacggttactttaacgtttattacttcgtacttactttacaacttaacgacggtaacaaaccaaccgtaaacgttcggttacggttacggggttcggttacgggggaaccgggggtaacgggttaaaaccgttaaacgggtttcccggacccggtttccggtaccggttacccgaaaccgggtacccccgtaaaacgggggtccccttccccggtacccccggtttacccggtccctttacccggtttaccctttccccggtttaacccccccg

SEQ ID NO: 303630 - DNA, 584 bp, Homo sapiens
  misc_feature: GZ8MTXP02FJ48E.25.22.B11.1.454.CMB.2.raw
  modified_base (234)..(234): a, c, t, g, unknown or other
  misc_feature (234)..(234): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggngcttataactatgtctcctggtcccaacaacacccaggcaacggcccccaaactcatcatttangatgtcagtcatcggccctntggtagtttctggtccgtcttcctctggctccaagtctgcaactcggcctccctgaccatcgtcggggctccgagtctgaggacgaggtctacgttatagttgctatttcattacagtaacgaccaaccaaacgtagtcttagggtcgttcggggacgggtaacgggacctaaaggttcggaacccgttccgtcggggtacaccggcccgtaaaggcccgtacggccccccgttcggggtcctaccgttccgttccgtttcccccg

SEQ ID NO: 303631 - DNA, 695 bp, Homo sapiens
  misc_feature: GZ8MTXP02IPQJD.25.22.B11.1.454.CMB.2.raw
  modified_base (220)..(220): a, c, t, g, unknown or other
  misc_feature (220)..(220): n is a, c, g, or t
  modified_base (311)..(311): a, c, t, g, unknown or other
  misc_feature (311)..(311): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgactagttggtgtcttaataactatcgtctcctcgtacccaaacaaccaccgagaccaacggacccccaaactcatactaatttangtatgtcagtctactccggtcccttgtggtacgtttcgtcggtcgtctttcgtctcgtctctagtccgtgcctacgtccgtccctcccgtgacctgtccggtccggggtctcccgaggtccgtaggaacgggtacgacggtctttaacgtttattagttcgtacttaacttttacaaacttacgaacgtaacgaacccaaaccgtaacgtacggttcgtagggttcggttacggggacggggtaacgggtaaccgtaaacggtttccggaacccggtttccggtaccgggttaccgacccggtacccggtaaaccggtcccgttccccggtcccccggtttacgggtacccttaccgtttcccgtttacccggtttcccccccg

SEQ ID NO: 303632 - DNA, 621 bp, Homo sapiens
  misc_feature: GZ8MTXP02IQBOM.25.22.B11.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctctgtcccaacacaccaggacaacgaccccaaatcatcatttatgatgtcagtcagtccggccctcgtgtacgtttctggtcgtctttcctcgtcggctcctaagtcctggcctaaccgtcggccctccctacgaccatccgtccggggcctaccgaggcgtggacggacgtaggtacttaacttattacttcgacttaactttcaattacgaagaacgaaccaaaccaaactagttaccgtgggttcgttacgggcgggtaaccggtactaaacggttcggaacccgttccggtacggtaccgaccgacccgaacggtcccgtaccgacccccgttcggaccctaccgttccgttacccgtttacccccg

SEQ ID NO: 303633 - DNA, 584 bp, Homo sapiens
  misc_feature: GZ8MTXP02F8DG2.25.22.B11.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggntcttanaactatgtctcctgtccaacaacaccagcaacgccccaacncatacatttatgatgtcagtcacgtccgccctcttggtagtttcgtggtcgtcttccctctgtctccaagtcgtggcctaacgtccggtcctcccgtcgtaccacgtcgtccggggctccgnggtctaggaggacgacggtcttacttattattcgtatactttacattacagaacgaccaacaacgagtcgtaggtgttcgggacgggtacggaactacgttacggaccgttccgtacgtcgacgacccgaaggtcccgttcgacccccgttcggtacctaccttccgtaccgtttaccccc

SEQ ID NO: 303634 - DNA, 742 bp, Homo sapiens
  misc_feature: GZ8MTXP02FKONX.25.22.B11.1.454.CMB.2.raw
  modified_base (235)..(235): a, c, t, g, unknown or other
  misc_feature (235)..(235): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccagccgtgactattggtncttataactatgtctctggtcccaacaacacccaggcaacggcccccaaactcatcatttatgatgtcagtcactccgccctgtggttagtttcgtggtccgtcttcctcgtcgtctacctaacgtcgtacgccgtaccgtccggtccctaccctcggtaacctacgtcccgggtccgggggtcctacccggagggtctaggggaacgggaacggtacgggttacctttaaccgttaatttacgttagttacctttaagtttaccaacgtaacgtaaacgggtaacaaccctaaacccgtaaacgtaacggttacgttacgggggtttacgggtttaccgggggaccgggggtaaaacggggaaaccgtttaaaccggggtttaccggtaaccccgggtttacccgggtccggttaccgaacccgtaccggtaaaccgtcccgttccccgggtcccccgttaccggggtaaccctaccgtttacccgttacccggtttcccccccgg

SEQ ID NO: 303635 - DNA, 729 bp, Homo sapiens
  misc_feature: GZ8MTXP02JREGB.25.22.B11.1.454.CMB.2.raw
  modified_base (332)..(332): a, c, t, g, unknown or other
  misc_feature (332)..(332): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactcggaaccagccgtgactagttggtatactttaataactattcgtcctccgttacggtaccccaaacaaccacccgaacggaccaaacccggacccccaaaactcaacttactattttanagtatgtactagtccacgtcccggtccctgttacggttcgtttcgtcggtctcttccgtcgtcgtactacgtagtcgacgcctaccgtcccgtcctccgtctaccgtcgtccggtccgggtccgtaccggtacggtcgtacggacggtacggtacgtactttaacgttagttacgttactacttattactaacgtaacgagtaaccgaacctaaccgtaacgtacggttcggttacgggttacggggttaccggggacgggtaacgggtaaccggttaacgggttacccggtacccgggtccgttaccggtaccgtaccggtacccggtaaccggtcccgtaccccggttacccccgtccggtacccgtacccgttcccgtttaccccgttaccccc

SEQ ID NO: 303636 - DNA, 647 bp, Homo sapiens
  misc_feature: GZ8MTXP02G23RX.25.22.B11.1.454.CMB.2.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (628)..(628): a, c, t, g, unknown or other
  misc_feature (628)..(628): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctcctgcactggaaccagccgtgactagtttgggtntcttaataactatcgtctcctggtacccaaacaaccacccaggcaacggacccccaaactcatctaatttangtatcgtcagtcacgtccggccctcgttggtacgtttcgtggtcgtcttcctcgtcggtctaccgaagtctggcctaacgtccggtccctaccctcgaacctctccggcgggtcctcccgaggtcgtaggacgggacgtacggtaccttaactttagttacttcgacttatttactacgttaacgaacgttaacgaaccaaaccaaacgtacgttccgttaggttcggttacggggacgggtaacgggtaccgtaaaggtcgtaaccggtcgtccggtacgaccggcccgtaaggtccgtaccggccccgtcggtacnccgttccgtccttcccccg

SEQ ID NO: 303637 - DNA, 673 bp, Homo sapiens
  misc_feature: GZ8MTXP02GI291.25.22.B11.1.454.CMB.2.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctggactctggacngtcgtcaccntctcctgcactggaaccagccgtgactagttggtncttaataactntcgtctccgtcgtacccaacacaccagaccaacgaccccaactcatcatttngtntgtcagtcacgtccgtcctcgtggttacttcgtcggtcgtcttacccgtcgtacgtcctccgaagtcgtcgccgtaccgtccggtccctcccgtcgacctacgtcccgtcggggtccctaccggtacggtcgacggacggtaaccgtcggttactttacgtttaaagttctcgtacttaactttccgaattaaccgacggaacgaaccctaaaccgtaacgttacggttcggtttggttacgggttaccggggagggtaaccggggtacttaaaccgggttcggtacccgggttccgtccggtactaaccggcccgaaggttcccgcccggttaccccgtcggtcctaccgttccgttcccgtttacccccg

SEQ ID NO: 303638 - DNA, 683 bp, Homo sapiens
  misc_feature: GZ8MTXP02HRY75.25.22.B11.1.454.CMB.2.raw
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
tcagactgtacagtcacgaccggtgctcgatttagacgacagctcagggggagctctgggagaagagccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctgggacgggtccctgagactctcctgtgaagtctctggattcaccatcaatgactatttanggctggactccgcaggctccgaggggaggggctgggagtggtattctatttanctagtagtgggtaggtaagtggactatttataaactccaagtccctcgtccgggaacggggtcccgaccttccgaccctacgtccctaccggaacgggaaccgaaccgggacccaactaacttacctaaccttccttttctcggtacgtaaacggttacggaaaccggtaccggtacccggaccgggaccggaacgggtaccgaacccggggtccgttacggttaccgtttcgtcggttaggaccggtaagggttacggggtttcggggggttactttaggttagtaagtcggtaccgtacgggttacggtttaccttaaccccgttaccctttaaaccg

SEQ ID NO: 303639 - DNA, 705 bp, Homo sapiens
  misc_feature: GZ8MTXP02JFFPD.25.22.B11.1.454.CMB.2.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgtcttaataactatcgtctcctggtacccaacaacaccagcaacgccccaaatcatcatttangatgtcagtcatccgcctntggtactttcgtcggtcgtctttccctacgttcggcctaccgtaagtcgtacggacctaaccgttccgtacccgttcccctacggtaacccctaacgttcccgtccgggggtccctaccgaacgggcccttagggaacgggtacgacggtctttaaacgttatttacgttcgtaccttatttacaacttaaccgtaagtaaccgtaaacccaacctaaaacgtacgttacccgttaggggttcggttaccggggacgggtaaacgggtaaccccgttaaaaggttccggtaaacccggttccgttaccggtaccgaccggtacccgaacggtccgtaccccgcccccgttacggtacctaccggtttccctacgggtttccccccg

SEQ ID NO: 303640 - DNA, 659 bp, Homo sapiens
  misc_feature: GZ8MTXP02FGYM7.25.22.B11.1.454.CMB.2.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagactgtacagtcacgaccggtgctcgatttagacgacagctcaggggggggtctcagggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctctgcactggaaccagccgtgacagtttggncttaataacttntgtctcctggtcccaacaacacccaggcaacgcccccaaatcatcattatgatgcagtcatcggccctntggtatttcnggtcgcttctctgctcagtctgcactcgctccngacanctcgggctccgaggctgaaggtacgaggtaccttaactttagttaattcggtactacttttacaacttaacgaacgtaacggaaaccaacccaaaacgtacgttaccttggggttcggtttaccgggggccgggtaaaagggggaaaccccttaaaaggggttacggtaaccccggtttacccgtacccggggtttaaccggaccgttacccccggaaaaggtccccgtacccggtacccccccttccggggtaaccctaaccgttaccccgtttccgtttaccccccccgg

SEQ ID NO: 303641 - DNA, 813 bp, Homo sapiens
  misc_feature: GZ8MTXP02HL2ZU.25.22.B11.1.454.CMB.2.raw
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
tcagactgtacagtcacgaccggtgctcgatttagacgacagctcaggggagctctggggagaagagccccagccccagagttcccaggagtttccattcggtgatcagcactgaacacagaggactcaccatggagtttgggctgagctgggttttccttgttgctcttagtaaaaggtgtccattgtcgaggtgctaggttggtgcgagtcgtgggggagtcttcgtcaagtccgtgggacgggtccctgacgactctccgtgtagagtctntggtactcacatcaatnacttacttatcggtcctggactccgtcgacggccgtaccggaaggggaacggggtcggtagggtacgggttaggtttactttacgttaagttttacgtacgtaaaggttaaggtacggggtaaggttaaggttacgggtaacttaagttttaacttaaccgtaaccgtaaacggtaccgttaccgggttacccgggggaccgggggtacccccttacgtttaccccgaaccttaccgtttacccggacccggtaaaccgggggaccctaaacccggggacccaaactaaccttaaacctacctttaccctttcgacggaaacgtttaagacggtaaacccggttaccggtaacccgacggtaccgggaacgggtaacccgtacggggtaccgtttaccgtacgttccggtaggtcgggtaaacgtagggggttagggtttacggggtttaacttgggtagtaaccggtgtacccggtttacggttcgtttaaacccctaccccgtttacccgtttaaaccgg

SEQ ID NO: 303642 - DNA, 642 bp, Homo sapiens
  misc_feature: GZ8MTXP02JR4B3.25.22.B11.1.454.CMB.2.raw
  modified_base (249)..(249): a, c, t, g, unknown or other
  misc_feature (249)..(249): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (481)..(481): a, c, t, g, unknown or other
  misc_feature (481)..(481): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactattgggtatcttaataactntcgtctcctcggtaccaacaacaccgagcaacggccccaaactcatctatttatcgatgcagtnacgtccggcctctggtacgtttctggtccgtnttcccgtcgtcggtcctaccagtcgtcgcctaaccgtcggtcccctccgtacgacccgtctcggttccgggcttacccgaggcgtagacggacgaggtcttatagttacttgtcttatttacattaacgacggaanaacccaaccgtaaactacggttcgttagggtcggttacgggaacggtaacgggtaccgtacgggttaccgtaccggtaccggtaccggacgtaccgaccggaacggtcccgtacccggtaccccgtccggtaccgtacccgttaccgttcccgttaccccg

SEQ ID NO: 303643 - DNA, 645 bp, Homo sapiens
  misc_feature: GZ8MTXP02F03OJ.25.22.B11.1.454.CMB.2.raw
  modified_base (319)..(319): a, c, t, g, unknown or other
  misc_feature (319)..(319): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcaggcacagggtcctgggcccagtctgccctgactcagcctgcctccgtgtctgggtactccgtggacaggtccggtcaccatctcctgcactgaaccaggcgtagactagttggtcgtacttaataactatcgtccttcctacgacccaacaaccaccaggaccaaccggacccccaaatcactactatttanagtactgtacagtctacgtccggtccttcgtcggttacgtttcgtcggttcgtccttccgtcgttcgacttaccgtaagtccgttacgccctaccgtcccggtcctacccgtcaccgtacgtccggtccggctcccgtaggcgtaggaacggtacgacgttacgttactttagtagtctattaattnaacagtacganaaccgaaccgacgtaggtcgtacggtggttacgggacgggtaacggtacgtaacggtcgtaccggttcgacggtaccacgaccgtaacgggctacccgtcccgtcgtacctcctcgtcccgttacccc

SEQ ID NO: 303644 - DNA, 591 bp, Homo sapiens
  misc_feature: GZ8MTXP02G3FLL.25.22.B11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (431)..(431): a, c, t, g, unknown or other
  misc_feature (431)..(431): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgccatggaaccngccgtgactagttggtncttaataactntcgtctctggtccaacacaccagcaacgccccaaactcatcatttatgatgtcagtcagtcggcccttcgtggtatttcgtggtcgtcttccctcgtggtacctccgaagttccgtgggcctaaaccgtcggtcccctccgtacgacctatcccggtcgggccttccgaggctaggagacgnggacttacttattatgtactactttacattacagtaacacaaaccaacgtacgtagtcgggtagtacgggacgtaacgggaactaacggttcgtaccgttcgcgtacgccgacctaacgggctcccgaccccgtcgacctaccgttccgtacgttccccc

SEQ ID NO: 303645 - DNA, 576 bp, Homo sapiens
  misc_feature: GZ8MTXP02FQ819.25.22.B11.1.454.CMB.2.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (449)..(449): a, c, t, g, unknown or other
  misc_feature (449)..(449): n is a, c, g, or t
tcagactgtacagtcacgaccggtgctcgatttagacgacagctcaggggggggtctcaggaggcagcgctctcgggacgtctccaccatggcctgggctctgctgttccctcaccctcctcactcagggcacagggtcctgggcccagtctgccctgactcagcctgcctccgtgtctgggactcctggacngtcgtcaccntctctgcactggaaccngccgtgactagttggtntcttaataactatcgtctctcgtaccaacacaccagacaacgaccccaatcatcatttangtatntcagtcacgtccgccctgtggtatttcgnggtctcttcctcgtcgctacgaagtcgngccactccggtccctccctcgaccncgtccgtcgggctaccgagtcgtaggagtacgagttcttaacgtttattagtctacttactttanaacgtataacggaactaaccaacccaatcggttcgttagggtcggttacgggacggacggtaccgtagtccgaccgtcgtcgtcaccgcgtagcctcccgtccgtcgcctacctccgtccttacccc

SEQ ID NO: 303646 - DNA, 674 bp, Homo sapiens
  misc_feature: GZ8MTXP02JES1T.25.22.B11.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (311)..(311): a, c, t, g, unknown or other
  misc_feature (311)..(311): n is a, c, g, or t
tcagactgtacagtcacgaccggtgctcgatttagacgacagctcaggggggggtctcaggaggcagtgctctcgggacgtctccaccatggcctgggctctgctgttcctcaccctcctcactcagggcacagggtcctgggcccagtctgccctgactcagcctgcctcgtgtctgggactcctggacaggtcgtcaccatctcctgcactggaaccngccgtagactagttggtntacttaataacttntcgtctcctcgtacccaacaaccaccaggacaaccggaccccaaactcatactatttangatgtcatcatccggtcctgtggtgtttctggtctcttccgtcgtcgtcctactacgtacgtcgcctaccgtccggtcccttacccgtcgacctacgttccgtccggggtccctaccggtaggtcgtaggaaccgggtacgtacggtactttaacgtttaagttattagtacttattacctaaagttacgaacgtaacaaaccaaacctaaagtacggttcgttacgggttacggttccggggaacggtaacggggtaaaccgtacggtttaccggtaacccggttcgttaccggtacgaaccgtaccggaacgtccgtacccggtcccgtacggtcctaccgttccgttacccgttaccccc

SEQ ID NO: 303647 - DNA, 529 bp, Homo sapiens
  misc_feature: GZ8MTXP02FJ7M0.25.22.B11.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (426)..(426): a, c, t, g, unknown or other
  misc_feature (426)..(426): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtgcttataactatgtctcctggtcccaacaacacccaggcaaggcccccaaatcatcatttangatgtcagtcatccggccctctggtagtttcnggtcgctttcctctgctccaagtctggcaactcggcctccctgaccatcgtcggggctccgagctgagacgaggctacgttattattgctattcatanagtagacaccaacagtctggtgtcggcgagggacagttgaccgtccgtacggctacgcccgaaggccgtcgcccccgtacggtcctacgtcctcgttaccccc

SEQ ID NO: 303648 - DNA, 839 bp, Homo sapiens
  misc_feature: GZ8MTXP02G7W79.25.22.B11.1.454.CMB.2.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtagactagttggtnactttataactntgtctctgtccaacaacaccagcaacgccccaaactcatcatttatgatgtcagtcactcggccctctggtacgtttctcggtcgtcttcccgtcgtcggtcctaccgtaacgttcgttacgggtcctaaaccgttcccggggtacccttcccccgttacgtaaccccgttaacgttcccgggttacccggggggtccctttaccccggaaggggtcccgttacgggggtaaacccggggaacccggtaacgggggttacctttaaacccgttttaatttacgtttacggtacctttaacgttttactaaacgtttaaccgtaaacggttaaaccggaaaccctaaacccctaaaacgttaaacggtttccgttaggggtttaccggtttaccgggggtaaccggggtaaaccggggtaaaccgttaaacggggtttaaccggtaaaccccgggtttccggttaaccccggggtttaccgaaaacccgggttcccccggtaaaaacgggttccccgttacccgggtccccccgtttaacccggggtaccctacccgtttaccccggtttacccggtttaccccccccgg

SEQ ID NO: 303649 - DNA, 529 bp, Homo sapiens
  misc_feature: GZ8MTXP02JPKEH.25.22.B11.1.454.CMB.2.raw
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacaccaggcaacgccccaaatcatcatttangatgtcagtcatcggccctctggtagtttcgtgtcgtcttcctctcggtctcaagtcttggcctaactcggacctccctgaccatcgtcgggctcgaggctggacgatgagtcttacttattactgctattcatacagtacgacaccaacagtctggtgtcgaggacgacctagtacgaccgtcgtacgtacacgtccgaaggcctaccgtcccctcggtccaccgtcgttcccg

SEQ ID NO: 303650 - DNA, 764 bp, Homo sapiens
  misc_feature: GZ8MTXP02GSY3E.25.22.B11.1.454.CMB.2.raw
  modified_base (311)..(311): a, c, t, g, unknown or other
  misc_feature (311)..(311): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcacgtggaaccagccgtgactagttggtgtacttataactattcgtcctcctcggtcccaaacaaccaccaggacaacgcccccaaactcatctatttangtatgacatcatccgaccctgtggtacgtttcgtcggtccgtcttccctcgtcggccttccgtaacggttccgtcggtaccgtaaacccgtcccgggtccccttccccgttaccgaaccgtacgtcccgggttacccgggggcccttacccggaagggtcccgtaggaaaccgggggtaccggtaacggtacctttaaaccgtttagttaagtttcggaacctttaagtttacctaaagttaaccgaacgaaacggtaaacccaacccgtaaacgtaacggttccggttaaggggttcgggttaccgggggaccggggtaaacgggtaaccggtaaaacgggtttcccgtaaacccgggttccccgttacgggtaccgtaaccgtacccggaacggtccgtacccgcccccggttaacggtccctaaccgtcccgtttacccggttccccccg

SEQ ID NO: 303651 - DNA, 540 bp, Homo sapiens
  misc_feature: GZ8MTXP02FPTW6.25.22.B11.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
  modified_base (442)..(442): a, c, t, g, unknown or other
  misc_feature (442)..(442): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactntgtctctggtcccaacacaccaggcaacggcccccaaactcatcatttangatgtcagtcatccggccctctggtagtttctggtcgtcttcctctgctcatctgcactcggcctccngaccatcgtcggggctccgagctggaggacgaggtcttaacttattattgacttattcatacagaagacaaccgaacngtcgtaggtgtcgggcggaaggaccgtaagttcgacgtccgtacggtcacgacccaaggccgtcgtacccccgtcggtacctctccgtcgttcccccg

SEQ ID NO: 303652 - DNA, 645 bp, Homo sapiens
  misc_feature: GZ8MTXP02FTGTT.25.22.B11.1.454.CMB.2.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggacctcctggacaggtcggtcaccatctcctgcactcggaaccngccgtgactattggntacttaataactatgtcctcctcgtacccaaacaacacccaggaccaaccgacccccaaatcactctaattanagtatgttcagtactacgtccggccctaggtgttagtttcgtggtcctcttctcgtagtcctacgtaactcggtacggcctaacgtcccggtcctccctagaaccctntcccgggtcggcttcccgaggtcgtagacccgggtagacgttacttaacgttattacgtctnttaactttcaactaaccgtaaggaaccaccttaaaccgaagtcgttacggttgggtcgtcgggaacgggtagaaacccgttagtccggtaaccggtttcgacgtaccacggacctacggccttccccggcccgtcgtccaccgtttcgtcccccggtttcccc

SEQ ID NO: 303653 - DNA, 777 bp, Homo sapiens
  misc_feature: GZ8MTXP02ITYTO.25.22.B11.1.454.CMB.2.raw
  modified_base (296)..(296): a, c, t, g, unknown or other
  misc_feature (296)..(296): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactgaaccagccgtgacattggtgtcttataactatgtctctcgtccaacacaccagacaacgcccccaaactcatactatttangatcgtcagtcagtccggtaccccttcgttggtacgttttcgtgggttccgtcctttccgtccgttcgggtaccttacccgtaaacggtttccgtacgggtaccgtaaaccgttccccggggtcccccttcccccgttcgggaaccctaacgttcccgggttacccggggggtccttcccggaggtcccgttaggggaacgggaacggtacggggttactttaacgtttaaacgtttacgttacgtactttaactttttaccaaacgtttaaccgaaggaacggtacccaaaacccgtaaagtaccggtttacgttcggggttacggtttaccgggacgggggtaaacggggtaacctaaacgggtttaccggaccccgtttaccggtcggttaccgaaaccggtcccccggaaaggttcccgtcccggtacccccgttaccggttacctacccgtttcccgtttcccggtttaccccccg

SEQ ID NO: 303654 - DNA, 530 bp, Homo sapiens
  misc_feature: GZ8MTXP01D96N3.17.78.H01.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctcagtgaaggtttcctgcaaggcttctggatacaccttcacgacgtatgctattcactgggacnccacggcccccganacagccttgagtggatgggatggatgaacgttgaacaagtgggaaatacgagtatatcaacaagaaattccgagggcagagtcacatacagacanancgacgaacacagcctacatgagctgacgggggctgaacatactagaacgacacggtctttatattactgtgcgcgagagtggcttggcagaaggagggctaacgacgttcggccttccggaaccccggg

SEQ ID NO: 303655 - DNA, 586 bp, Homo sapiens
  misc_feature: GZ8MTXP01EPR35.17.78.H01.1.454.CMB.2.raw
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (550)..(550): a, c, t, g, unknown or other
  misc_feature (550)..(550): n is a, c, g, or t
tcagcgtagactagcacgaccggtgctcgatttagtgtgagtagtttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaaatattaacctgtttcccatcgactacgcctttcggcctcgccttaggggtcactcaccctgccccgattaacgtggacaggacccttggtcttcggcgagcgggtcttttcacccgtntttatcgttacttatgtcagcattcgcncttctgataccctccagcatcgcctcacagcattacccttcacaggacttacagaaccgcctacccctaacccaaacaaccgcaataagccgtcgctcgcccgcacgcttcggtgctagttcggtttacgcccccgtttcncttcccttcccgctaactctgactaagttcgtaacg

SEQ ID NO: 303656 - DNA, 601 bp, Homo sapiens
  misc_feature: GZ8MTXP01CJKA0.17.78.H01.1.454.CMB.2.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacagaatattaacctgtttcccatcgactacgcctttcggcctcgccttaggggtcactcaccctgccccgattaacgtgacaggacccttggtctcggcgagcggctttcgacctnttancgttactatgtcagcattcgctaacttctgacttacccncgancactctcctcacacactactaccttacacacgtactacaacgaccgaccctacccctaacccaaaccaaccacaactaacgcgtccgcgtcgtccgccgcgtcgttcgtcgttcgtacgttcggtttaccgttcccgttccgttccttccttcccgtcctctctcttactaacgttcgtcg

SEQ ID NO: 303657 - DNA, 492 bp, Homo sapiens
  misc_feature: GZ8MTXP01DNSPB.17.78.H01.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagctgggctnagtgagttcngcagctngatacnctnanacgtangnatcactggacncaggccccganacagctgagtgatggatggatgaacgttgacaagtggaatacgagatatcaacaagaaatcgagggcagagtcacataccaggacanatcgacgaacacagcctanagngagcgtgacgggggcctagacatacagaagacacggtcttaatatactgtgcgngagagtggcttgnacgaagaggcgacacgacgcgttccgtaaccccggg

SEQ ID NO: 303658 - DNA, 523 bp, Homo sapiens
  misc_feature: GZ8MTXP01DU7WG.17.78.H01.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagcctgggcctnagtgaaggttcngcaggcttcngatacacttcacgacgtatgctattcactgggtacnccacggcccccgganacagccttgagtggatgggatggatgaacgttgacaatggaatacgagatatcanaagaatcaggcagagtcacatacaggacacancgcgaacacagcctacatagagctggacgggggcctaggaccatctagaagactaacggtctttatattacgtgtaacgcgcgaggagtggcttgggcacgaaggagggcaacacgttcggtcgttccggaaccccgg

SEQ ID NO: 303659 - DNA, 605 bp, Homo sapiens
  misc_feature: GZ8MTXP01B5D0S.17.78.H01.1.454.CMB.2.raw
  modified_base (471)..(471): a, c, t, g, unknown or other
  misc_feature (471)..(471): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (558)..(558): a, c, t, g, unknown or other
  misc_feature (558)..(558): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacagaatattaacctgttccatcgactacgcctttcggcctcgccttagggtcactcaccctgccccgattaacgtggacacggaacccttggtcttccggcgagccgggtcttttcgacccgtctttatcgttacttatgtcagcattcgctaacttctgactcctccagcatcgcctcacacgcatacccttcacacggcttacacgaaaccnccctacccctaaccaaacaaccacaataacgccgtccncncgccgctcgtcgttcggtcgctacgttcggttaccgtccccgtttcncctttccccgttcccgcctaacttcgtacgttacctcgttcgtaacg

SEQ ID NO: 303660 - DNA, 551 bp, Homo sapiens
  misc_feature: GZ8MTXP01ELNKH.17.78.H01.1.454.CMB.2.raw
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttccngcaaggcttctggatacaccttcacgacgtatgctattcacgtgggtaacnccacggcccccgganacagccttgagtggatgggatggatgaacgttgacaagtgggaataccgagatatcacaaagaaattccgagggcaggatcaacctattacccgaggacacactccgacgaacacacgcctacagtggagcgtggaccgggggtctaggacagtcgagaacgacgacggttattatattactggtgcgcgaagcgtggacttggcacgaagagggcacgacgttcggccgttcggaaccccggg

SEQ ID NO: 303661 - DNA, 604 bp, Homo sapiens
  misc_feature: GZ8MTXP01AUF7Y.17.78.H01.1.454.CMB.2.raw
  modified_base (416)..(416): a, c, t, g, unknown or other
  misc_feature (416)..(416): n is a, c, g, or t
  modified_base (531)..(531): a, c, t, g, unknown or other
  misc_feature (531)..(531): n is a, c, g, or t
  modified_base (559)..(559): a, c, t, g, unknown or other
  misc_feature (559)..(559): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacagaatattaacctgtttcccatcgactacgcctttcggcctcgccttagggtcactcaccctgccccgattaacgtggacaggaacccttggtcttccggcgagcgggtcttttcgacccgtctttatcgttacttatgtcagcattcgcaacttcngactacctccagcatcgcctacacagccatacccttcgacaggtacttacagaaccgccttacccccaaccaacaaccgcaataacgcgttcgctcgccgcacggctttcgggcnctacgttcggttaccgtccccgtttacncttccctccccgctaacttccgtacgttactaacgttcgtaaccg

SEQ ID NO: 303662 - DNA, 603 bp, Homo sapiens
  misc_feature: GZ8MTXP01AL2KU.17.78.H01.1.454.CMB.2.raw
  modified_base (293)..(293): a, c, t, g, unknown or other
  misc_feature (293)..(293): n is a, c, g, or t
  modified_base (431)..(431): a, c, t, g, unknown or other
  misc_feature (431)..(431): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctcagtgaaggtttcctgcaaggcttcgtggataccaccttcacgacgtatgctattcactgggtacncccacggcccccggacacagccttgagtggatgggatggatgaacgttgaacaagtgggaataccgagtatatacacaaagtaaatccgagggcagacgtcacataccgaggacacatccgacgaacacacgcctaanacgtggacgtcgtacggaacggggggcctaggacctagtccgtaggaaacgtaccgtaacggtctttaacgtattaccgtgtcggcgacggagagtcgggcgttcgggcaccggaagggacgggaaccaaccgtaacgttcgggtaacccgttccccggtaacccccggggg

SEQ ID NO: 303663 - DNA, 554 bp, Homo sapiens
  misc_feature: GZ8MTXP01E3EU9.17.78.H01.1.454.CMB.2.raw
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (447)..(447): a, c, t, g, unknown or other
  misc_feature (447)..(447): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacacctacacncgagtcncncacacncgtcgtcgtcgcgcgcgacgcgtacgtacgtaggtaggtaggtaggtaggtaggtagtagtagtaacgtaagtagagacgtagtagtagtatactaactacgtaacgacgacgacgcgacgacacacacgacgacgacgacgacgacgacacacacgacgcgcgcncgcggctcgacgacgtacgacgacgacgtacgtacgtacgtacgtacgtcgtcgtcgttcgtcgcgcgtcgcgcgcgcgacgcgacgacgaccgtccgttccgtccg

SEQ ID NO: 303664 - DNA, 580 bp, Homo sapiens
  misc_feature: GZ8MTXP01BF1YC.17.78.H01.1.454.CMB.2.raw
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
  modified_base (547)..(547): a, c, t, g, unknown or other
  misc_feature (547)..(547): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgatttttccggatttgcctaggaaaaccagcctacacgcttaaaccgggacaaccgtcgcccggcaacatacgccttctcccgtcccccttcgcagtaacaccaagtacagaatattaacctgttccatcgactacgcttcggcctcgcttagggcactcaccctgccccgattacgtgacaggaccttggtctcggcgagcggtctttcaccgtntttatcgttacttatgtcagctattccgctcttcngtactaccctccagcatcgcctcacngcatacccttcacacgtacttacaacgaaccgccctacccctaacccaaacaaccgacaataacgcgtccgctcgccgcacgtcttcggtgctagttcggtttaccgtccccgtttncttcccttcccgctctctgactcgttcgtaacg

SEQ ID NO: 303665 - DNA, 542 bp, Homo sapiens
  misc_feature: GZ8MTXP01ALLDJ.17.78.H01.1.454.CMB.2.raw
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacnccacggcccccgganacagccttgagtggatgggatggatgacgttgacagtgggaatacgagatatcacaagaaacttccgagggtcagagtacacattaacccgagggacacactccgacgaacacagcctacgatgagcgtcggacgggggctaggacagtcgtgaagacgtacggtctttatattactggtgcgcgagagtggcgttgcagaaggcggaacacacgttcggccgttccggaacccggg

SEQ ID NO: 303666 - DNA, 529 bp, Homo sapiens
  misc_feature: GZ8MTXP01CJTN7.17.78.H01.1.454.CMB.2.raw
  modified_base (376)..(376): a, c, t, g, unknown or other
  misc_feature (376)..(376): n is a, c, g, or t
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
tcagcgtagactagcacgaccggtgctcgatttagtgtgagtagtttgggtttggggaccatatttggacccaacaaccacatccctcctcagaagccccagagcacaacgcctcaccatggactggacctggaggatcctctttttggtggcagcagccacaggtgtccactcccaggtccatcttgtgcagtctggggctgagatgaagaagcctggggcctcagtgaaggttcctgcaaggcttctggatacaccttcacgacgtatgctattcactgggtacgccaggcccccggacacagccttgagtggatgggatggatgaacgttgacaatgggaataccgagatattcacaagaatcaggcagagtnacataccagggacacgatccgcgaacacagcctacagtgaagcgtgaacgggggctggacagtctagaacgacacggtctttaatattaactggtaagcgngagagtggcttcggcacgaagngggctacgacgttggaacttcgaaccccgg

SEQ ID NO: 303667 - DNA, 619 bp, Homo sapiens
  misc_feature: GZ8MTXP01CO0R2.17.78.H01.1.454.CMB.2.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaacctgtttcccatcgactacgcctttcggcctcgccttagggtcgactcaccctcgccccgattaacgttggacaggaacccttcggtcttccggcgagcgggtcgtttctacccgcgtttactcgttacttactggtcagcattcgcncgttctgatactccagcagtcnctcacanctactactcacagtactacgacgaccgccctaccccgaaccaaccacacactacgccgtcgctcgcccgcgtcgtcgttcggtcttcgtacgttccggttttaccgtccccgtttacttccttcccgttccccgacttaacgtccgttacgttaaccttcggttccgtaacg

SEQ ID NO: 303668 - DNA, 670 bp, Homo sapiens
  misc_feature: GZ8MTXP01EE4QS.17.78.H01.1.454.CMB.2.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagccgtgggcctnagtgagttcngcagcttctggatacaccttcacgacgtatgctattcactgggtacgccacggcccccganacagccttgagtgatggatggatgaacgttgaacaagtgggaataccgagtatatcaacaagaaattccgagggcagacgtacacatacgaggacacatccgacgaacacacgacctaacgacgtgggaacgaccgtcgggaaccgggggtccgtacggaaaccgtacttaccggtaaggaaacggtaaccgtaaccgggttaaccttttaaagttaacttttaaccgtggtttaacggacccggttacgggaaggttaacggttggggtaccgttcggggacccttaaaccgggaaggggaaaccggggaacccaaaccggtaaccggttaccggggtaaccccgttaaccccgggtaaacccccccggggg

SEQ ID NO: 303669 - DNA, 608 bp, Homo sapiens
  misc_feature: GZ8MTXP01BKETH.17.78.H01.1.454.CMB.2.raw
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagccgtgggcctnagtgaagttcctgcaggcttcgtgatacaccttcacgacgtatgctatcacgtgggtacgccacggcccccganacagcctgagtggatgggatggatggaacgttgaacaagtggaataccgagatatcacaaagaaactccgagggcaggacgtaccaacagttaacccagggacacgacgtccgacgaaacaccagtaccctaacgagtacggagcgtacggaccgggggccttaggaacattcgaggaacgacgtacggtactttaattattacgttggtcggcggacggagttaacgtgggtcgttacggggcacggaagggacgggaaccaaccggaacggttccgggaaccgttaacccgggtaacccccggggg

SEQ ID NO: 303670 - DNA, 543 bp, Homo sapiens
  misc_feature: GZ8MTXP01D32GE.17.78.H01.1.454.CMB.2.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (440)..(440): a, c, t, g, unknown or other
  misc_feature (440)..(440): n is a, c, g, or t
  modified_base (503)..(503): a, c, t, g, unknown or other
  misc_feature (503)..(503): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcttctttttggnggcagcagccacaggtntccactcccaggtccatcttgtgcagtctggggctgagatgaagagcctgggcctgagtgaaggtttccngcaaggtcttcnggataccaccttcacgacgtatgctattcacttcgggtacgccacggcccccganacagccttgagtggatggatggatgacgttganagtagggaatacgatatatcaacaagaatcgaggcagatcacatacagacacancgacaacacacgactacagtgagcgtacgacgggggctgaccatacngaacgtacgtacgtactttagtacttacgtgtcggcgaggagttagtcggcttagggcaacgnggagggcaacgtaacgttcggtcccgccggtaaccccggg

SEQ ID NO: 303671 - DNA, 620 bp, Homo sapiens
  misc_feature: GZ8MTXP01CFL95.17.78.H01.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcttctttttggtggcagcagccacaggtgtccactccaggtccatcttgtgcagtctggggctgagatgaagagcctgggcctnagtgtaaggttccngcaggctngatacncttnacgacgtatgctattcacgtgggtaccnccgacggccccccggaanacgacgtccgtggaggtggagtgggatggaataggtaacgttagaagtaaggtaggaaatacggatatagtacaacgtaaagtaactcggaaggacaggtacaccaactacgtacgacgacacacgaccgacgaacacacgactacgagagacgacgtacggaccggggtacgtacgtacgacgtacgtacgtaacgtacgtacgttacgttaattacgttacgtcggtcggtcggacgtacgttacgtcggtcgcggacgacggaacggacggaacgacgtacgttaccggtaaaaaaccggttcccggtaacccggg

SEQ ID NO: 303672 - DNA, 590 bp, Homo sapiens
  misc_feature: GZ8MTXP01CT17F.17.78.H01.1.454.CMB.2.raw
  modified_base (150)..(150): a, c, t, g, unknown or other
  misc_feature (150)..(150): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (522)..(522): a, c, t, g, unknown or other
  misc_feature (522)..(522): n is a, c, g, or t
tcagcgtagactagcacgaccggtgctcgatttagtgtgagtagtttgggtttgggggaccatatttggacccaacaaccacatccctcctcagaagccccagagcacaacgcctcaccatggactggacctggagatcctctttttggnggcagcagccacaggtgtccactcccaggtccatcttgtgcagtctgggctgagatgaagagctgggcctgagtgagttcngcaagcttcngatacaccttnacgtacgtatgctattcacgtgggtaaccnccgacggcccccccggaanacgacgtccgtaggaggtggagtgggataggtataggaacgtagaacgtaagtggaatacgatatactacaataaagtaactcggaggacaagtactacaactactacgacgacacacgaccgaacgaacacacgtacacgagagacgtacgtacggaccggggtactagactacgtacgtagaacgtacgtacgtatttatacgtcgtgtcgcgagtagngtcggcgttcggcgaacggaacggacggtaacaacgtacgttacggtcccgttaacccgggaacccgg

SEQ ID NO: 303673 - DNA, 602 bp, Homo sapiens
  misc_feature: GZ8MTXP01ASITD.17.78.H01.1.454.CMB.2.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcttctttttggtggcagcagccacaggtgtccactcccaggtccatcttgtgcagtcgtggggctgagatgaagagccgtggggcctcgagtgaaggtttcctgcaaggtcttcgtggatacaccttcacgacgtatgctattcacgtgggtacnccgacggcccccgganacacgccttgagtggagtgggatggatggaacgttgaacagtggaatacgagtatatcaactaaagaacttcgagggcagcgtacactattaccgaggacacgactccgacgaacacgacgacctaacagtggacgcgtacgggacgggggctaggactacgtacgtaagaacggtaaccaacggttactttaattagtttaccgtgggttcgcggttacgtaaggttagtcggcgttacggcacggaaggacgggccaacgtacgttcggccgttcccggtaaccccggg

SEQ ID NO: 303674 - DNA, 655 bp, Homo sapiens
  misc_feature: GZ8MTXP01A82E8.17.78.H01.1.454.CMB.2.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagcgtagactagcacgaccggtgctcgatttagtgtgagtagtttgggtttgggggaccatatttggacccaacaaccacatccctcctcagaacgcccccagagcacaacgcctcaccatggactggacctggaggatctttctttttggtggcagcagccacaggtgtccactcccaggtccatcttgtgcagtcgtggggctgagatgaagaagccgtgggcctnagtgtaggtttccngacagtcttgtgatacaccttnacgacgtatgctatctacgtcgggtaccncccgaccggcccccganacgacgtccgttgaggtgagtgggatggatagaacgtgaagagtaggaataccgatatactacaactaagtaaactccggagggtacacggtacgtaccaacgtacttaacgacggacacacgtaccgacgaacacacgacctacgacgtagacgacgtacggacgggggacgtacgtaccgtacgtacgtaacgaacgtacgtacggttactttaacttacgtttacgttggtaacgtcggacgtggaaaaggtcggtcggttcggaccgacggaacggggaacgggaaccgtaaccggacggttacccggtaacccggttaaccccgggtaacccccgggg

SEQ ID NO: 303675 - DNA, 602 bp, Homo sapiens
  misc_feature: GZ8MTXP01DHUE7.17.78.H01.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtcgtggggctgagatgaagagctgggctnagtgaaggttcngcaaggtcttcnggatacaccttcacgacgtatgactattcactgggtaccgcccgacgggccccccggaaaccgagcccttgagtggatgggatggatgaacgttgaactaaagtcgggaaataccggagtatacttnaacaaaagaaacttccgaagggtccaagacgtacaaccgtagttacccgagggaacacactccgacgaacacgacgacctaacagtcggactcgtacggaccgggggaccgttacgactaacgtctaacgaaagactaacggtctttaaagtacttaaccgtggtgcgcgagagtaggccttaggcacgaagacgggcaacgacgttcgccgttcccggaaccccgg

SEQ ID NO: 303676 - DNA, 577 bp, Homo sapiens
  misc_feature: GZ8MTXP02FLE46.17.78.H01.1.454.CMB.2.raw
  modified_base (412)..(412): a, c, t, g, unknown or other
  misc_feature (412)..(412): n is a, c, g, or t
  modified_base (518)..(518): a, c, t, g, unknown or other
  misc_feature (518)..(518): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcgacccgctttatcgttacttatgtcagcattcgcncttctgatacctccagcatgcctcacagcatacctcacaggcttacagaaacgcctacccctacccaacaaccgcaataacgcgtcgctcgccgcagcttcgggtnctacgttcggttaccgtccccgtttacacttcctcccgctactctagactacgtctacg

SEQ ID NO: 303677 - DNA, 569 bp, Homo sapiens
  misc_feature: GZ8MTXP02JMKN8.17.78.H01.1.454.CMB.2.raw
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctcagtgaaggtttccngcaaggcttctggataccaccttcacgacgtatgctattcactgggtacnccgacggcccccggacacagccttgagtggatgggatggatgaacgttgaacaagtgggaatacgagtatatcanagaatccgagggcagatcaactataccgagacacacnccgacgaacacacgacctaacatggagcgtacggacgggcctagactagtacgtagaagaaccgtacggtactttaagtactttaacgtgtcgcggacgacgtagtcggcgtacggacaacgaaggaacgggacaacgaacgtcggaccgtacccggacccccggg

SEQ ID NO: 303678 - DNA, 556 bp, Homo sapiens
  misc_feature: GZ8MTXP02JMXPA.17.78.H01.1.454.CMB.2.raw
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (457)..(457): a, c, t, g, unknown or other
  misc_feature (457)..(457): n is a, c, g, or t
  modified_base (500)..(500): a, c, t, g, unknown or other
  misc_feature (500)..(500): n is a, c, g, or t
  modified_base (540)..(540): a, c, t, g, unknown or other
  misc_feature (540)..(540): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctcccgtcccccttgcagtaacaccaagtacagaatattaacctgtttcccatcgactacgccttcggcctcgccttagggcactcaccctgccccattaacgtgacaggaccctggtctcggcgagcgggctttcgacccgnttancgttactatgtcagctattcgcncttctgacttaccctccaagcactcgcctcacacncactaccttcacacgctacacgacncctaccctacccaaccaacacactaacgacgacgctcgccgcncgctcgtcgctctgttacgtcccgttcctctctccgtccnctctgactactactcg

SEQ ID NO: 303679 - DNA, 529 bp, Homo sapiens
  misc_feature: GZ8MTXP02J1OSO.17.78.H01.1.454.CMB.2.raw
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccgganacagccttgagtggatgggatggatgaacgttgacagtgggaatacgagatatcananaatccagggcagagtcacataccaggacacatccgacgaacacagcctacatgagctggaccgggctgacatctagaacgacacggtctttagtattacgtgtcgcgcgagagtcggtcgcgggacacgaaggacgggacacgtaacgcggccctacggacccccgg

SEQ ID NO: 303680 - DNA, 528 bp, Homo sapiens
  misc_feature: GZ8MTXP02FQXYW.17.78.H01.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacnccaggcccccgganacagccttgagtggatgggatggatgaacgttgacaatgggaatacgagatatcacagaaattcagggcagatcacataccaggacacatcgacgaacacagcctacataggagcgtcggacgggcctagacctatctagaagacacggtactttanattacngtcgacgngagatcggactcggacacgaaggacggacacgaacgtcggacctcgaccccgg

SEQ ID NO: 303681 - DNA, 558 bp, Homo sapiens
  misc_feature: GZ8MTXP02GZ840.17.78.H01.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctcagtgaaggtttcctgcaaggcttctggatacaccttcacgacgtatgctattcacgtggtacnccacggcccccganacngccttgagtggatgggatggatgaacgttgaacaagtgggaatacgagatatcanagaatcgagggcagagtcacattacaggacacactaccgacgaacacacgacctaacagtggacgacgtggaccgggcctagacatacgagaaacgacgacggtactttaagtacttacgtgtcggacggtcgaagagtggcgtacggacaacgaaggacggacaacgaacgtcggacccgtaccggaacccccgg

SEQ ID NO: 303682 - DNA, 553 bp, Homo sapiens
  misc_feature: GZ8MTXP02HJKBD.17.78.H01.1.454.CMB.2.raw
  modified_base (306)..(306): a, c, t, g, unknown or other
  misc_feature (306)..(306): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcacgtgggtacgccgacggcccccgganacagccttgagtggatgggatggatgaacgttgaacaagtgggaataccgagatattcaacaagaaattccgagggcaagagtaccaacattacccgaagggacaacatccgacgaaacacagacctacagtggagctggacggcctgacatcagaacgacgacggtctttaatacgttactgtcgcgtacgagtagtcggactggacacgaaggacggacaacgaacgtcggacctacgaccccgg

SEQ ID NO: 303683 - DNA, 553 bp, Homo sapiens
  misc_feature: GZ8MTXP02HDRWA.17.78.H01.1.454.CMB.2.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (482)..(482): a, c, t, g, unknown or other
  misc_feature (482)..(482): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttnacgacgtatgctatcactggtacgccgacggcccccgganacagccttgagtggatgggatggatgaacgttgaacaagtggaatacgagatatcanagaatcgaggcagngtcacataccaggacacactacgacgaaacacgacgaccaacgatggaacgcgtacggaacgggcccttaggactagctagaacgacgacggtactttatagttacngtcgcgtcgagagtcggcgtacggacaagaacggacgggacaacgtaacgtcggcctacccggaccccggg

SEQ ID NO: 303684 - DNA, 578 bp, Homo sapiens
  misc_feature: GZ8MTXP02HJKF7.17.78.H01.1.454.CMB.2.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctgggcctnagtgaaggtttccngcagtcttgtgatacacctnacgatangactatcacgtggacnccgacggccccganacagtctgagtggagtggatggataggtaacgtgaacaagtaggaaataccgagtatactacaanaagtaactccgaaggacagacgtacaactaataaccgagacaacagtccgaacaaacacgacgacctaagagtagacgcgtacggaccgggtctagactagtacagaacacgtacgtactttaactagttacgtcggtacgtacgtagacggtagtacggacgtacgacgaacgaacggaacggacgacgaacgtacggtaccgtaccggtacccgg

SEQ ID NO: 303685 - DNA, 529 bp, Homo sapiens
  misc_feature: GZ8MTXP02I6BV1.17.78.H01.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacnccaggcccccganacagccttgagtggatgggatggatgacgttgacatggaatcgagatatcacagaatcgaggcagagtcacattaccaggacacatccgacgaacacagacctacagtggacgcgtaggacgggcctagacagtaccgagaagacgacggtctttatagttacgtgtcgacgtcgagtatggcgtgcacgaaggacggacacgaacgtcggaccgtacgaccccgg

SEQ ID NO: 303686 - DNA, 582 bp, Homo sapiens
  misc_feature: GZ8MTXP02F954M.17.78.H01.1.454.CMB.2.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttccngcaaggcttcnggataccacttcacgacgtangtctattcactgggtacnccacggccccccggaanacgcgctggaggtggagtgggagtggagtacggtaacgttagaaacgtaaggtagggaactacgaagtattatacaacgaagtaactcgaggacaagtactacaactacgtacgaagacacgacgaccgacgaaccacacacctacgagacggacgacgtacggacggtcgagactagtacgaacgagacgtacgtacttatacgttacgtgtacgcgagacgtagtcggcgacgacgacgaaggacgacacgacgtcggaccgtaccggaccgg

SEQ ID NO: 303687 - DNA, 598 bp, Homo sapiens
  misc_feature: GZ8MTXP02IZ4HP.17.78.H01.1.454.CMB.2.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatccttctttttggtggcagcagccacaggtgtccactcccaggtccatcttgtgcagtcgtggggctgagatgaagagccgtgggcctnagtgtaagtttcngcagcttngatacnccttcacgcgtatgctattcacgtgggtaccgccgacggcccccganaccgagccttgagtggagtggggatggatgaacgttgaacaagtggaatacgagtatatacanaagaactcgaggcagacgtcaacattacgagacacacgaccgacgaacacacgactacgagtagacgacgtacggaccggtacgtacgacgtacgtacgtaacgaaacgttttttaacgaacggtttaacgtttattaacgttacgttggtcggtacggacgtacggtagtcggtcgtacggacgaacggaaggacggacgaacgtacgtacggtccgtacccggtaccccggg

SEQ ID NO: 303688 - DNA, 573 bp, Homo sapiens
  misc_feature: GZ8MTXP02I727H.17.78.H01.1.454.CMB.2.raw
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctcagtgaaggtttccngcaaggcttctggatacaccttcacgacgtatgctattcactgggtacnccacggcccccgganacagccttgngtggatgggatggatgaacgttgaactaagtgggaataccggagatattacacaagtaaacttccgaggacagacgtaaccataccgagggacacatccgacgaacacacgcctacagtggagcgtaggaccggggctacggacctatcgtagaaacgaccgtaacggtactttaattattactggtgacgacgagagttcggacgtgacgacgaggaacgggacacgaacgtcggacctccggaccccgtcggggg

SEQ ID NO: 303689 - DNA, 556 bp, Homo sapiens
  misc_feature: GZ8MTXP02IVGDQ.17.78.H01.1.454.CMB.2.raw
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccataacgttgacaggaaccttggtcttcggcgagcgggtcttttcacccgtntttatcgttacttatgtcagcattcgcncttctgactacctccagcatcgctcncaagcaatactcacagctanagacnctcccacanacncaataagctcgctcgcgcncgcgtcgtcgctcgtacgttacgtccgttcctctctccgtcctactactacgtactacgtactacg

SEQ ID NO: 303690 - DNA, 558 bp, Homo sapiens
  misc_feature: GZ8MTXP02FOHP3.17.78.H01.1.454.CMB.2.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagcctggggcctnagtgaaggtttccngcaaggcttctggatacaccttcacgacgtangctattcacgtgggtacgccacggcccccganacagccttgagtggatgggatggatgaacgttgataagtggaatagagatatcaanagaatcgagggcagagtcacattaccgaggacacactccgacgaaacacacgacctaacagtaggacgcgtacggaaccgggccctaggacacgttccgaagaacgactacggtctttatacttacgtgttcgcggagaaggtgtggccgtaggcaacgaaggacggacacgaacgtcggccgtaccggaaccccggg

SEQ ID NO: 303691 - DNA, 640 bp, Homo sapiens
  misc_feature: GZ8MTXP02HWM6L.17.78.H01.1.454.CMB.2.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatcctctttttggnggcagcagccacaggtgtccactcccaggtccatcttgtgcagtctggggctgagatgaagaagcctggggcctnagtgaaggtttccngcaaggtcttcgtggatacaccttcacgacgtatgctatcactgggaccnccgacggccccganacncgctgagtggagtggatggatacggtaacgtgaaacgtaagtacgggaaataccgaagtacttaactacaaacgaagtaaacgttccgaagggacaagtacgtaccaaccgtaacgtaacccgaaggaaccaacgacgtacccgaacgaaaccgaacgaacgtacctaacgacgtacggacgacgtacggaccgggtctacgaactacgtacgaagaaacgaacgttacgttactttaagttacgttacgtcgtcgacggtacggacgtacgtacggtacgtacgacgacgaacggacggacgacgaacgtacggtaccgtacccggacccgg

SEQ ID NO: 303692 - DNA, 590 bp, Homo sapiens
  misc_feature: GZ8MTXP02I5K3Y.17.78.H01.1.454.CMB.2.raw
  modified_base (306)..(306): a, c, t, g, unknown or other
  misc_feature (306)..(306): n is a, c, g, or t
tcagcgtagactagcacgaccggtgctcgatttagtgtgagtagtttgggtttggggaccatatttggacccaacaaccacatccctcctcagaagcccccagagcacaacgcctcaccatggactggacctggaggatccttctttttggtggcagcagccacaggtgtccactcccatgtccatcttgtgcagtctggggctgagatgaagaagccgtggggcctcgagtgaaggtttcctgcaaggcttctggataccaccttcacgacgtatgctatcacgtggtacgccacggcccccganacagcctgagtggatgggatggatgaacgttgaacaagtggaaatacgagtaatattacaacgtaagattccgagggacaagacgtaccaaaccaattaaccgaacgggaacaacacgtaccgaacgaaacaccaacgacctaacagtagggacgccgtaggaccgggacctacgaacgtacgtacgagaaacggaacgtaccggtacgtttaatacgttacgtagtgcggacgaagagtcggctggacaacgaggacggacaacgacgtcggaccgtacccgg

SEQ ID NO: 303693 - DNA, 524 bp, Homo sapiens
  misc_feature: GZ8MTXP02GMR97.17.78.H01.1.454.CMB.2.raw
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
  modified_base (505)..(505): a, c, t, g, unknown or other
  misc_feature (505)..(505): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactggtacnccacggcccccganacacgccttgagtggatgggatggatgaacgttgacagnggaatacgagatatcanagaaatccagggcagagtcacataccgaggacacanccgacgaaacacacgctacagtggancgtgacggcctgacagtctagaagacacggtctttatattacgngtcgacgtgagagtggactggccagaagaggctaacgacncggtcctcggaaccccggg

SEQ ID NO: 303694 - DNA, 571 bp, Homo sapiens
  misc_feature: GZ8MTXP02IZH38.17.78.H01.1.454.CMB.2.raw
  modified_base (241)..(241): a, c, t, g, unknown or other
  misc_feature (241)..(241): n is a, c, g, or t
  modified_base (404)..(404): a, c, t, g, unknown or other
  misc_feature (404)..(404): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttccngcaaggcttctggatacaccttcacgacgtatgctattcacgtggtacgccgacggccccccggacacgagccttgagtggagtgggatggatgaacgttgacaagtgggaatacgagatatacacagaattcgagggcagactcacattaccagggacacanccgacgaaacacacgacctacgagtaggacgtcgtacggaccggggcctagaaccgtagtacgtacgaacgaccgtacggtactttataacttcgtagtcggacgtacggagtacgtggcgtaggcaacgaaggacggacaacgacgtcggacctaccggaccccgg

SEQ ID NO: 303695 - DNA, 604 bp, Homo sapiens
  misc_feature: GZ8MTXP02FP8SP.17.78.H01.1.454.CMB.2.raw
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (456)..(456): a, c, t, g, unknown or other
  misc_feature (456)..(456): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacagaatattaacctgttcccatcgactacgcctttcggcctcgccttaggggcactcacctgccccatacgtgacaggaccctgtctcggcgagcgggctttcgaccgtctttancgttactatgtcagctatcgcncttctgatacctccaagcatcgccctcacacgcatacctcaacaggcttaacacgaaaccncccttaccccaacccaaacaactacaataaacgcgtcgctacggccgcagtccttcggtgccttaacgttcgggtttaaccgtcccccgttttacacctttcccgttaaccccgcaacttctacggtaaccttacggtaccttaccgg

SEQ ID NO: 303696 - DNA, 543 bp, Homo sapiens
  misc_feature: GZ8MTXP02HYZQV.17.78.H01.1.454.CMB.2.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagcgtagactagcacgaccggtgctcgatttagtgtgagtagtttgggtttgggggaccatatttggacccaacaaccacatccctcctcagaagccccagagcacaacgcctcaccatggactggacctggaggatcctctttttggtggcagaagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccgganacagccttgagtggatggatggatgaacgttgacaatgggaatacgagatatcacagaaacttcgngggcagngtcacattacagggacacatccgacgaacacacgcctacagtggagtcgaggacggggtcctggactataccgtagaaacgacgacggtctttatattactgtgcgcgtagatgggctggggcaacgagaacgggtcaaacgactggccgtacgaccccgtcggggg

SEQ ID NO: 303697 - DNA, 566 bp, Homo sapiens
  misc_feature: GZ8MTXP02GIYC6.17.78.H01.1.454.CMB.2.raw
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcacgtgggtaccgccgacggcccccgganacagccttgagtggatgggatggatggaacgttgaacaagtggggaaatacggaagattaattcaacaagtaaattccgagggcagacgtcaactataccgaggacacatccgacaaacacagcctaanactaggagcgtacggacgggcctagactatacgtagaacgacgtacggtactttaatattacgtgtcgtcgagagagttcggctggacacgaaggacgggacaacgaacgtcggcctaccgaccccggg

SEQ ID NO: 303698 - DNA, 651 bp, Homo sapiens
  misc_feature: GZ8MTXP02IPUHX.17.78.H01.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatctttctttttggtggcagcagccacaggtgtccactcccaggtccatcttgtgcagtctggggctgagatgaagagctgggcctnagtgaagtttcngcagcttntgatcacttcacgacgtatgctattcacgtgggtacgccgacggcccccgganacagccttgagtggatgggatggatgaacgttgaacaagtaggggaataccggaagtattagttacaacgtaagtaaaacttcccggaaggggtccaagggtacttacccgaaacctaagttaacccgaaggggacacacgtaccgacgaaacacacgacctacaagtaggacgtacgtacggaccgggaccgttaggaacctacgtacgtacggaaacgaaccgtacggttaccttttaattacgttaacgttcggttcggaccggacggtaacgtacggtgggtccgttacgggaccacggaaggacgggtaccaaaccgaacgtccgggaccgtacccggacccccgggg

SEQ ID NO: 303699 - DNA, 539 bp, Homo sapiens
  misc_feature: GZ8MTXP02HQG29.17.78.H01.1.454.CMB.2.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctgggctgagatgaagaagcctggggcctcagtgaaggtttcctgcaaggtcttctggatacaccttcacgacgtatgctattcacgtgggtacgccacggcccccganacagccttgagtggatggatggatgaacgttgacaagtgggaataccgagtatattcanaagaatccgagggcaagcgtcacataccaggaccacgatccgacgaaactacgacgcctaacagtcgagctcggacggcctgacatctgaaacgcacggtntttagtattacgtgtcgacgnganagtcggctggaccagaagacgggcacgaacgtcggacctaccggacccgg

SEQ ID NO: 303700 - DNA, 627 bp, Homo sapiens
  misc_feature: GZ8MTXP02HXQRF.17.78.H01.1.454.CMB.2.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (436)..(436): a, c, t, g, unknown or other
  misc_feature (436)..(436): n is a, c, g, or t
tcagcgtagactagcacgaccggtgctcgatttagtgtgagtagtttgggtttgggggaccatatttggacccaacaaccacatccctcctcagaagccccagagcacaacgcctcaccatggactggacctggaggattctttctttttggtggcagcagccacaggtgtccactcccaggtccatcttgtncagtctggggctgagatgaagagctgggcctnagtgagttcngcagcttngatacnctnacgactatgctatcactggaccnccgacggccccgaacgagccttgagtggagtgggtatgggataggaacgttgaactaaggtggaaactacggagtaattacttacaacgtaagtaaactttccggaaggggacaaggtacgtacctaaaccgtaaattaacccgaagggaaccaacgtacncccgaacgaaaccacgtaacgcctaacgagtaggacgtcggtacggaccgggtacttacgactacgttacgacgtaacgaccgtacggttacttttataacgtttacgtggttacgacggtacgagtacgtcggtacgtcgacacggtaacggacggactaacgacgtccggcccgtacccggaccccggg

SEQ ID NO: 303701 - DNA, 584 bp, Homo sapiens
  misc_feature: GZ8MTXP02IG9EQ.17.78.H01.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagagcctgggcctnagtgaaggtttcngcaggcttctggatacaccttcacgacgtatgctattcacgtgggtaccnccgacggccccccganacagccttgagtggatgggatggatgaacgttgaactaagtgggaataccgagtatattcaanagaaattccgaggggcaagacgtaccaactattaacccgaagggaacaacacgtacccgacgaaacacacgacctacagtggagcgtggaccgggcctgacatactagaacgacgacggtatttactagttacgtggtcgcgtcggagtagtcggccgtagggacacggaaggacgggaccaaacgaaccgtcggacccgtacccggacccccgggg

SEQ ID NO: 303702 - DNA, 586 bp, Homo sapiens
  misc_feature: GZ8MTXP02IXWSK.17.78.H01.1.454.CMB.2.raw
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
  modified_base (530)..(530): a, c, t, g, unknown or other
  misc_feature (530)..(530): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttaggggtcactcaccctgccccgattaacgtgacaggaccctggtcttccggcgagcgggtctttcacccgtntttatcgttacttatcgtcagctattccgctctttctagtactaccctccagcatcgcctcacagctactaccttcactacggacttacacgaaccncctacccctacccaacaaccgacaataacgcgtacgctcgaccgcacgcttcggnctacgttcggttactcccgttcacttcctcccgcctactctcgactacgtactacg

SEQ ID NO: 303703 - DNA, 645 bp, Homo sapiens
  misc_feature: GZ8MTXP02GFKB5.17.78.H01.1.454.CMB.2.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (380)..(380): a, c, t, g, unknown or other
  misc_feature (380)..(380): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagccgtggggcctgagtgaaggtttccngacaaggtcttcgnggactaccaccttcgacgtacgtatgcttatcacgtgggtacnccgacggcccccganacagtccttggagtggagtgggatggataggacgttgaacaagtgggaatacgagtattactacanaagtaaacgttccgaaggggacaaggtaacgtccaaacccgtaagttaacccgaagggtaccaacgacgtcccggaacaaacccgacgacgtaccctaacgtagtacgggacgcgtacgggaccgggtcccttaggaccacgttacgtaagaacgaaccgtacggttaactttaagttacgttagtcggtacgccggagtacggtagcggtcgtcggaccacgaaggacggacaacgtacgacggtaccgtacccggtacccggg

SEQ ID NO: 303704 - DNA, 583 bp, Homo sapiens
  misc_feature: GZ8MTXP02IFALL.17.78.H01.1.454.CMB.2.raw
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (516)..(516): a, c, t, g, unknown or other
  misc_feature (516)..(516): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggatattaactgttcccatcgactacgctttcggcctcgcttagggcgactcaccctgccccgattaacgtggacaggaacccttggtctccggcgagcgggcttttcgacccgntttacncgttacttatgtccagcattcgctacttcctgactacctccaagtcaatcgcctcacagcattaccttcacngcttacagaacccncctacccaaccacacncatacgcgtcncgtcgccgctacgtcgttacggngctacgttcggttaccgtcccgttcgtacttccgttcccgctacgtcgtcgtacgtacgtacgtacg

SEQ ID NO: 303705 - DNA, 449 bp, Homo sapiens
  misc_feature: GZ8MTXP02H11JA.17.78.H01.1.454.CMB.2.raw
  modified_base (275)..(275): a, c, t, g, unknown or other
  misc_feature (275)..(275): n is a, c, g, or t
  modified_base (424)..(449): a, c, t, g, unknown or other
  misc_feature (424)..(449): n is a, c, g, or t
tcagcgtagactagcacgaccggtgctcgatttagtgtgagtagtttgggtttgggcagaaattccagggcagagtcaccattaccagggacacatccgcgaacacagcctacatggagctgacgggcctgacatctgaagacacggctttatattactgtgcgcgagatggctggcacagagggcacaactggctcgaccccgtggggccagggaccctggtcaccgtctcctcagcctccacgaacggcccatcccgtcttcccccgtggccnccctgcctccgaggacgcaccgtccgagacgcacgacggccggccccgtggggcctcggccgtggtaccgaaacggtacctacccgttccccgtagtctaccgcctggacggccggggtctcggggacgaaacgggccgataagtacgnnnnnnnnnnnnnnnnnnnnnnnnnn

SEQ ID NO: 303706 - DNA, 609 bp, Homo sapiens
  misc_feature: GZ8MTXP02H2UQJ.17.78.H01.1.454.CMB.2.raw
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagaagccacaggtgtccactcccaggtccatcttgtgcagtctggggctgagatgaagaagccgtggggcctcagtgaaggtttccngcaaggcttcgtggatacaccttcacgacgtatgctattcacgtgggtacgcccgacgggcccccgganaccgagcctttggacgtggagtggggatgggataggacgttgaacgagtaggggaaatacgagtatattcaagaagaaattccgaggggcaagacgtaccaactactaaccgagggacacacgtaccgacgaaccacgacgacctagagtcgggacgcgtaccgggacgggtacctaggactacgtaccgtagaaacgacgtacggttactttattacttactgtacgcgagagtacgtggactcggaccaagcgaaggcgtaacacggtacggaccgtaccggtaccccggccgggg

SEQ ID NO: 303707 - DNA, 584 bp, Homo sapiens
  misc_feature: GZ8MTXP02FIWC3.17.78.H01.1.454.CMB.2.raw
  modified_base (282)..(282): a, c, t, g, unknown or other
  misc_feature (282)..(282): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (546)..(546): a, c, t, g, unknown or other
  misc_feature (546)..(546): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccgccaaacatacgccttctcccgtccccccttcgcagtaacaccaagtacagaatattaacctgttccntcgactacgccttcgcctcgcttagggcactcacctgcccataacgtgacacggtacccttggtcttccggcgagcgggtctttcacccgtntttacgtcgttacttatcgtcagctactttcgctcttcngactaccctcagcatcgctcacnacacacctcacagtctanacgaaccncctaccccacccaaacgacacaanaacgtcgcnctcgccgctaggtcctcggtgactacgtttcggttaccgtcccccgtttancttccgttcccgacctactctacgtactacgtcctacg

SEQ ID NO: 303708 - DNA, 730 bp, Homo sapiens
  misc_feature: GZ8MTXP02HW0DE.17.78.H01.1.454.CMB.2.raw
  modified_base (250)..(250): a, c, t, g, unknown or other
  misc_feature (250)..(250): n is a, c, g, or t
tcagcgtagactagcacgaccggtgctcgatttagtgtgagtagtttgggtttgggggaccatatttggacccaacaaccacatccctcctcagaacgcccccagagcacaacgcctcaccatggactggacctggaggatccttctttttggtggcagcagccacaggtgtccactcccaggtccatcttgtgcagtcgtggggctggagatagaagagccgtggggcctcgaggtgtaacggtttccngacgaaggtcttcgtggtacttacctacccttcgaacgtaacgtatcgacttattcgacggtcgggtaaccgccccggaccgggaccccccggacaacgacgtccgttggacggtgggagtggggatgggaataggtaacgttgaaacgtaaggtaggggtaaaataccggaagtaattacttacgaaacgtaaaggttaaacttcccgggagggtaccaggtaccgttacccaacgtaacttaacccgaagggaaccaaccgactacccggaacgaaaccacgaaccgtacctaacgagtacgggacgacggtcggaccggggttactacggtaactaacgttcgaaaggtaacgaacgttacggttatttaaacttacgtttacgtcggtacggcgagtaacggtgttcggacgtacggaccgaacggaacgggacggaccaaccggtaacgcggacccgttcccgggaacccccggg

SEQ ID NO: 303709 - DNA, 598 bp, Homo sapiens
  misc_feature: GZ8MTXP02F13TH.17.78.H01.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctgggcctnagtgaagtttcngcaggcttcnggatacacttcacgacgtangctattcacgtggtacnccacggccccganacagccttgagtggatgggatggatgaacgttgacgatagggaataccgagatatcanagaattccgaggcagagtcacgataccaggacaacactaccgacgaacacacgacctacagtacggagacgtacggaccggggccttaggaacctaactcctaaggaaacgaccgtaaccggtacttttaacgtaatttaaccgtggtacggtacgaccggtagtaacgttcggacgtacggggacaacggaagacggggaccaaaacgtaacgtacgggaccgttacggtaacccccgggg

SEQ ID NO: 303710 - DNA, 652 bp, Homo sapiens
  misc_feature: GZ8MTXP02IFUUZ.17.78.H01.1.454.CMB.2.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (394)..(394): a, c, t, g, unknown or other
  misc_feature (394)..(394): n is a, c, g, or t
  modified_base (570)..(570): a, c, t, g, unknown or other
  misc_feature (570)..(570): n is a, c, g, or t
tcagcgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtcgtggggctggagagtgaagaacgccgtgggcctcgagtgtaaggtttcngacaggtcttcgtggatacaccttcacgacgtangctattcacgtggtaccgccgaccgggcccccgacacgcgccttggagtggagtgggagtggatcggtaaggttgaactaaggtgggaaataccgagtattacttacacgtaanaacgttccgagggtacaggtactacaacctagttacccgaggacacacgtaccgacgaacacgaccgactaacgagtagacgcgtacgggacgggtaccgtagacctagtacctaaacggaaacgtacgtaccggtttaacttttaacgttaactttaacgtggttacggaccggnggacggtaggtcggtcgtcggaccgtacggaagggacggtacgaaacgacggttacggcccggtacccgggtacccccgggg

SEQ ID NO: 303711 - DNA, 585 bp, Homo sapiens
  misc_feature: GZ8MTXP02IK54L.17.78.H01.1.454.CMB.2.raw
  modified_base (237)..(237): a, c, t, g, unknown or other
  misc_feature (237)..(237): n is a, c, g, or t
  modified_base (366)..(366): a, c, t, g, unknown or other
  misc_feature (366)..(366): n is a, c, g, or t
  modified_base (516)..(516): a, c, t, g, unknown or other
  misc_feature (516)..(516): n is a, c, g, or t
tcagcgtagactagcacgaccggtgctcgatttagtgtgagtagtttgggtttgggggaccatatttggacccaacaaccacatccctcctcagaagccccagagcacaacgcctcaccatggactggacctggaggatcctcttttggtggcagcagccacaggtgtccactcccaggtccatcttgtgcagtctggggctgagatgaagagcctgggcctcagtgaaggtttccngcaaggcttctggatacaccttgacgagtatgactattcactggtacgccacggcccccggacacagccttgagtcggatgggatcggatggtaacgttgacaagtagggaataccgaagatatacaanagtaaattccgagggacagtacgtcacaacttaccgaggacaacataccgacgaaacacgacgcctaagacaggacgcttaggacgggactagaactacgttaccagaaacgactacggtaactttaataagttaccgtagtgccggtanacggtaatcgggtcgtacgggcacgaaacgggagtaccggaactaaggtcgaccgttacgaccccgggg

SEQ ID NO: 303712 - DNA, 654 bp, Homo sapiens
  misc_feature: GZ8MTXP02GSJLS.17.78.H01.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (473)..(473): a, c, t, g, unknown or other
  misc_feature (473)..(473): n is a, c, g, or t
  modified_base (510)..(510): a, c, t, g, unknown or other
  misc_feature (510)..(510): n is a, c, g, or t
tcagcgtagactagcacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagtccttgtattttccggatttgcctaggaaaaccagcctacacgacttaaaccgggacaaccgtcgcccggcaacatacgccttcctcccgtcccccttgcagtaacacanacagatatacctnttccatcactacgccttcgcctcgcgttagggcactccacccgtgacccgtattacgtgaccacggtacccttggtcctccggcgacggccgggttccttttaccgacccgtattttactcgtttactttagtcgtacacgtactacttccgactctttcctagtaaccttaccctacccgtaagctagttcgaccttacncacgtactactacctcgactacgtactacacgtaccnccctaccctacaacactacaatacgctacgctacggcctcgtagtccgttcggacgtacttaacggtttccgtttaccggttaccccttactaccgttcccctaacgtaccctagttaccgtactacggttacctcgttaccgg

SEQ ID NO: 303713 - DNA, 576 bp, Homo sapiens
  misc_feature: GZ8MTXP01AF9CC.13.57.F02.1.454.CMB.2.raw
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaagggctggagtggattggggaaatctttcatagcggatcaccaactacaccgtccctcaagagtcgagtcaccatatctatagacaaaagtcccaagaacccacttctcccctgaacgtgagttctgtgaccgccgcggacacggccgtgtattacngtgcgagaggggtattggtggttttacncgtggttcaattgagttattatgtctttgacttagttggggcctaggggtaaccccttgggttccaccggtctccctcacgcccttccaaccgaacgggtcccc

SEQ ID NO: 303714 - DNA, 587 bp, Homo sapiens
  misc_feature: GZ8MTXP01AFRG4.13.57.F02.1.454.CMB.2.raw
  modified_base (566)..(566): a, c, t, g, unknown or other
  misc_feature (566)..(566): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgcagccccgagggaagggctggagtggagtggggaaatcgtttcagtagcggatcaccaactaccaacccgtccctacaagagtcgagtcaccatatctatagacaaagtacccaagaaaccctacttcctacccctagaacgtgaacgttcctagtcgacccgccggcggacgaccgggtccgtgttattacgtgtgacgagagggggtattggttggttttactcgtggttcaagttgtagttatattgttcttgacttgtcggggctacgggaccttgggcaccgtctctcncgccttccaacgaacgggtcc

SEQ ID NO: 303715 - DNA, 616 bp, Homo sapiens
  misc_feature: GZ8MTXP01EFAUL.13.57.F02.1.454.CMB.2.raw
  modified_base (518)..(518): a, c, t, g, unknown or other
  misc_feature (518)..(518): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgcagccccagggaagggctggagtggagttggggaaatcttcagtagcggatcaccaactacaaccccgtccctacaagagtcgagtcaccatatctatagacaaagtaccaagaaacctacttcctaccctagaacgtgtacgttctgtcgaccgcgacggacacggcgtagtattacgtgtgacgagaggggtatttggttaggttttactcgttggttactaagtgtagtttattaattgttntttaagacgttaggttcggggccgtaaggggtaaccccttgggttccacccgttcgtccctcgtaccgtcccttacccgtaacccgttaaggggcccc

SEQ ID NO: 303716 - DNA, 643 bp, Homo sapiens
  misc_feature: GZ8MTXP01EJ0IH.13.57.F02.1.454.CMB.2.raw
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgcacgcccccgagggaagggctggagtggagttggggaaatctttcataggcggatcaaccaactaccaaccccgtccctacaagagtcgagtcaccatatactatagacaaaagtaccaagaaccacttcctccctagaacgtgacgttcngtcgaccgcgcgacgacggccgtagtacttacgngtgacgagacggggtatttggttggtttactcgttgttacaagttgtaagtttatttagttgttcgtttaagtaacttgggttacgggggacccgtaaacgggggtaacccttcgggttccgttaacccgggttccctacccgttcacccggtcccttacccgaacccgttaaccggggtcccccg

SEQ ID NO: 303717 - DNA, 681 bp, Homo sapiens
  misc_feature: GZ8MTXP01B2NMK.13.57.F02.1.454.CMB.2.raw
  modified_base (288)..(288): a, c, t, g, unknown or other
  misc_feature (288)..(288): n is a, c, g, or t
tcagtcacgtactacacgaccggtgctcgatttagctcgatatagttgggtttggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggagtcttggtacagcctggcaggtccctgagctctcctgtgcagcctcgtggacttcactttgatgattancgccatcgctacgtcgggtccgacaacgcctaccggaaggggacgggtccgtagggtacggttcgggtactacgtaaggttagttaggttacggtaagttaggtaggtacgacgtaaagtacggtcgtagtcgggacggtactcggtagggtacggaacgggtccgtattaccacgtacttaccgacgaacgacgaaccaaccgaccgaaacgtacctaccgtagtactctacgaactaagtacgaacacgaccgtaggacgtacgtcgtacggaacggtaaccgacggtttacttagttagttaagttcgttaacgaacgttaaaacgttccctaaccccgttaaacccgtttagtttacggttttacggtaacggtttaacggttaaccgg

SEQ ID NO: 303718 - DNA, 638 bp, Homo sapiens
  misc_feature: GZ8MTXP01EDDBD.13.57.F02.1.454.CMB.2.raw
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgccacgcccccgaggggaagggctgggagtgggagttaggggaaattcgtttacagtaggcgggatcaaccaactaccaacccgtccctacgaagagtcgagtcacctatatactataagacaaaacgtaccaagaacctaccttcctcccctagaacgtgagttctgtcgaccgcgcggacacggtccgtgtactactgtgacgaggaggggtattggttggttttactcgttggttactaagttagtagtttattagtgtttcgtttaagtacgttagggtttcggggaccgtacggggtaacccttgggttcccttaccggttctcccgtcacggtccccttccgaaccgaaccgggtaacccc

SEQ ID NO: 303719 - DNA, 628 bp, Homo sapiens
  misc_feature: GZ8MTXP01DGSNV.13.57.F02.1.454.CMB.2.raw
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgccacgccccgagggagggctggagtggagttgggaatctttcatagcggatcaccaactaccaacccgtccctacaagagtcgagtcaccatatctatanacaaacgtacaagaaccctacttcctaccctagaacgtgtacgttctgtcgaccgccgcggacacggccgtgtactacngtgacgagaggggtatttggttagttttactcgttggttactaagttggtaattttattaacgttggtttcctttgtaactttagggtttcggggacccgtaaacggggtaaccccttggttcccgttacccggttctcccttcgacgtcccttaccgaacccgaacgggtaacccc

SEQ ID NO: 303720 - DNA, 727 bp, Homo sapiens
  misc_feature: GZ8MTXP01AZTBP.13.57.F02.1.454.CMB.2.raw
  modified_base (314)..(314): a, c, t, g, unknown or other
  misc_feature (314)..(314): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtataaagtggtggaggttggtccgccacggccccgagggagggctggagtggagtgggaatcttnagtagcggatcaccaactaccaacccgtccctacaagagtcgacgtcacactatactatagaactaaacgtaccaacgaaaccctaccttacctacccctagaaccggttagtagttccgtggtcgacccggccggaccggacgaccgggtccgtagtaacttacgtggtcgacggaggacggggttagtttggggtttacggtttttaactcggtttagggttctaaagtttggtaaagttttaacgtttagtttcgtttacgttttcgtaaaccggtttagggttcccggggggttaccgtaaacccggggggtaacccctttcggggttacccgttaaccccggttccgtttaccccctccggtaccccgtaccccgttaccccgtaacccgggttaacccgggtccccg

SEQ ID NO: 303721 - DNA, 787 bp, Homo sapiens
  misc_feature: GZ8MTXP01COVW1.13.57.F02.1.454.CMB.2.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccgttcggggaccctgtaccctaaatgcgctgtctntggtnactccatcagtcggtaagtaaagtgggtggtaggttcgggtcccgccgacggaccccccggaagggggaacggggcgtagggaggtagggtaaggttagggggtaaaacttcgtttacgaagttacgggaccggggtaactaccgaaaccctaaaccgtaaacccgtaaacccccgttaccccttaacgaaacggtacgtaccggaacgtaccaacctaacttactacctaagtaacgaacctaaaacgtaccaacgaaccctacttaccctaccctagtaacgtgtacgttctagtacggacccgcggacggacgacggtccgtagttacttaccgtgtacgacggtaaggtaggggttagtttcgggtttacggtttacgttcggttacggttaacgtaaagttaggttaagttttattagttagtttcgtttaaggtaacgttaggggttcggggaccgtaaacggggtaacccttggggttacccacccggttaacctccctaacgtaccgtacccttacccgaaccggttaaccgggtaaccccg

SEQ ID NO: 303722 - DNA, 561 bp, Homo sapiens
  misc_feature: GZ8MTXP02GQXNL.13.57.F02.1.454.CMB.2.raw
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactgggtgaagccttcggggaccctgtccctaaattgcgctgtctctggtgactccatcagcggtagtaaatggtggagttgggtccgccagcccccagggaagggctggagtggattggggaaatctttcatagcgggatcaccaactacaacccgtccctcaagagtcgagtcaccatatctatagacaaagtccaagaaccacttctacccctgaaacgtgagttctgtgaccgccgcggacacggccgtgattacngtgcgagaggattgtggttttacnctgtcaatgagttatatgtctttgacttattcggggcagggtaaccctggtcaaccggtctccctcacgccctaccaaccgaacgggcccc

SEQ ID NO: 303723 - DNA, 607 bp, Homo sapiens
  misc_feature: GZ8MTXP02G4AYJ.13.57.F02.1.454.CMB.2.raw
  modified_base (519)..(519): a, c, t, g, unknown or other
  misc_feature (519)..(519): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtcgccagcccccagggaagggctggagtggattggggaaatctttcatagcgggatcaccaactacaacccgtccctcaagagtcgagtaccacctatactactagacaactaacgtacaacgaacctacttacctcctagtaacgtgtactcgtgtacgaccgccggacgacgacggccgtagtactacgtgcgacgagagtagttgttaggtttactcgttagtatagtagttaagttattagtcgttnttacgtatttaggtcggtacgtaacgggtaccgtacggtaccgtaccgttcctccgtacgaccgccctaccaaccggaacggaccccg

SEQ ID NO: 303724 - DNA, 571 bp, Homo sapiens
  misc_feature: GZ8MTXP02I2M0U.13.57.F02.1.454.CMB.2.raw
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
  modified_base (546)..(546): a, c, t, g, unknown or other
  misc_feature (546)..(546): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaatggtggagttggtccgcagccccagggaagggctggagtggagttggggaaatctttacatagcggatcaccaactacaaccccgtccctcaagngtcgagtcaccatactctatagacaagtccagaaccacttcnccctagacgtgagttctgtcgaccgccgacggacacggccgtgtattacgngtgacgagaggtatttggttaggtttactcgtcggttctaagtgtagtttattatgttctttgacttagtcggggcctagggtaccctggtccaccgtctccncacgtcctaccaccgaacggtcccc

SEQ ID NO: 303725 - DNA, 615 bp, Homo sapiens
  misc_feature: GZ8MTXP02JNFQI.13.57.F02.1.454.CMB.2.raw
  modified_base (464)..(464): a, c, t, g, unknown or other
  misc_feature (464)..(464): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgcacgcccccagggaagggctggagtggattaggggaaatctttcatagcgggatcgaaccaactaacaaccccgtaccctcaagacgtacgagtccacaatatctaatagacaaagtccacgaacctacttacctccctagaccgtgtaagttcctgtacgaccgccgcggacacggtccgtgtaacttacncgtgacgaggtaaggatttggtacggttttactcgtagtttacaagttgtagttaattagttgtacttttagactttagtcggggtacctaaggggacccttcgggtcctaccggtcgtcctacgacgccctaccgaaccgacgggtaccc

SEQ ID NO: 303726 - DNA, 632 bp, Homo sapiens
  misc_feature: GZ8MTXP02FX3LW.13.57.F02.1.454.CMB.2.raw
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (514)..(514): a, c, t, g, unknown or other
  misc_feature (514)..(514): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccgttcggggaccctgtccctaaattgcgctgtctctggtgactcatcagcggtagtaaatggtggagttgggtccgcacgccccgagggaagggctgggagtggagttggggaaatcgtttacagtagcgggatcaaccaactaccaacccgtccctacaagagtcgagtcaccatatctatagacaagtacagaaccacttctaccctagaacgtgtacgttcngtcgaccgcgcggacacggccgtagtagttactgngcgaggnggtagttgttggttttactcgttggttacaagttgtaagtttattagttnttcgtttgtaacgtttaggttacgggggacctaacggggtaaccccgtcggttaccgtaaccccggttctaccccgttacgaccgtccccgtacccgaaacccgaacggggtcccccg

SEQ ID NO: 303727 - DNA, 630 bp, Homo sapiens
  misc_feature: GZ8MTXP02I0YK8.13.57.F02.1.454.CMB.2.raw
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccgccagcccccgagggaagggctggagtggagttggggaaatcgtttcatagcggatcaccaactaccaaccccgtccctacaagacgtcgagtcaccatactactataacgaacaaacgtaccaacgaacctaacctttcctaccctagaacgtgacgtttctgtcgacccgccgacggaccgacggccgtagtacttacgtgtgacgagtaggagtttgttaggtttactcgtggttactaagttggtagtttattagtgttctttagtacgttaggttcggggaccgtacgggtaacccgttggtacctaccgtccgtccgtactacggacccctccgaaccgtaacgggtaccccg

SEQ ID NO: 303728 - DNA, 629 bp, Homo sapiens
  misc_feature: GZ8MTXP02HPPC4.13.57.F02.1.454.CMB.2.raw
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggtagttgggtccgccgacgcccccgaggggaagggcgtggagtggagttaggggaaatcgtttacagtaggcgggatcgaacctaaactaaccaaccccgtccctacgaagacgtcgagtcacatatctatagacaagtcacgaaacctacttcctaccctagaaccgtgagttcctgtcgacccgccgacggacacggcccgtgtattacgtgtgacggagtaggtaatttggttaggtttaactcttagggttactaagtgttagtttaattagtcgttatttagaactttaggtacggggaccgtaacgggtaaccctcggtacctaccggtcctcgtacacgcctaccgaaccgtaacgggccc

SEQ ID NO: 303729 - DNA, 631 bp, Homo sapiens
  misc_feature: GZ8MTXP02HF23V.13.57.F02.1.454.CMB.2.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttggtccncacgccccgagggaagggcnggagtggagttggggaaatctttcataggcggatccaaccaactaaccgaaccccgtccctacaagacgtcgagtaccacatatctaatagacaacgtaccaagaaccctacttacctccctagaacgtgtagttctgtacgacccgccggtacggaccgacgggtcccgtagttacttacgtgtcgacggaggaggtagtttggttcggttttacgtcttggttactaagttgtagtttattagtgtttacttcgtacttggttcggggacctaacggggtaccctgggtacctaccggtctcccgtactacggccctccgaaccgaccgggtacccc

SEQ ID NO: 303730 - DNA, 613 bp, Homo sapiens
  misc_feature: GZ8MTXP02IJ909.13.57.F02.1.454.CMB.2.raw
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagacggtagtaagtggtggagttggtccgccacgccccgagggaagggctggagtggagttaggggaaatcgtttacgataggcggatacaccaactacaaccccgtccctacaagagtcgagtcaccatatactatacgactaagtaccacgaacctaacttcctaccctagacgtgtacgttctgcgacccgcgcggaaccacgggccgtgtaacttcgtgtagcgagaggtatttggttggttttactcgttggttacaagttgtatttagttagtgttactttgacttaggttcgggacctaacgggtaacccgtggtaccaccggtctccgtcgacgtcccctaccgaaccgaacggtaccccg

SEQ ID NO: 303731 - DNA, 632 bp, Homo sapiens
  misc_feature: GZ8MTXP02JXAN5.13.57.F02.1.454.CMB.2.raw
  modified_base (359)..(359): a, c, t, g, unknown or other
  misc_feature (359)..(359): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgacctccatcagcggtagtaaatggtggagttgggtccgccacgccccgaggggaagggctgggagtggagttggggaaatctttcagtagcggatcaaccaactacaaccccgtcctacaagngtacgagtcaccatactctatacgacaacgtacagaaacccacttcctacctagaacgtgtacgttctggtacgacccgccgccggaacncggccgtgttacttacgngtgacgagtacggtatttggtgtttactcgtaggttactaagttgtatttacgttattgttactttcgaagttaggtttcgggggaccgtacggggtaaacccgtcggttacccgaccggttcgacccttcgaccggtccctaccccgaacgtaacgggtccccg

SEQ ID NO: 303732 - DNA, 907 bp, Homo sapiens
  misc_feature: GZ8MTXP02IQXVB.13.57.F02.1.454.CMB.2.raw
  modified_base (303)..(303): a, c, t, g, unknown or other
  misc_feature (303)..(303): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactgggtgaagccgttcggggaccctgtccctaaattgcgctgtctctggtgactcatcagcggtagtaaagtggtaggaggttgggtcccgccacggcccccgaggggaagggcgnggagtcggagttaggggaaactcgtttacgagtacggacgggtactcaacccgtaaacctaaccaacccccgttacccgtaccgaaagacggttaccggagtaccaaccgtaactaactactaacgtaagaacctaaaacggttaccaacggtaaacccctactttaccccgtacccgttacgtaaaccggtgtaaacgttcctacgggttaccgtacccgggccccggtacgggaacccgtaacccgggtcccggttaaggtttaccgttaaaccggttcgggtacgtaaccgggtaacggtaacggggtaacgtttttaggggtttacgggttttttacccggtaacgtttacggggttttacccgtaaaagttttacggggtaaacgtttttaaagttttaaagtttccgggtttacgtttttaacggttaaaaccggtttttaggggttacccgggggtttaaaccccggaaaccgggggtttaaacccccggttacgggggtttaaccctacccccggggtttaacctttccccggtaaaccgtccccgggtaccccttacccccggtaaaacccggtaaaacccggggtaccccccgg

SEQ ID NO: 303733 - DNA, 753 bp, Homo sapiens
  misc_feature: GZ8MTXP02IQRIV.13.57.F02.1.454.CMB.2.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
tcagtcacgtactacacgaccggtgctcgatttagctcgatatagttgggtttgggggtgggaaatactttctgagactcatggacctcctgcacaagaacatgaaacacctgtggttcttcctcctcctggtggcagctcccagctgggtcctgtcccgggtgcagctgcaggagtcgggccaggactggtgaagccgttcggggaccctgtccctaaattgcnctgtctctggtgactccatcagcggtaagaagtggtggagttcggccgccacgccccgagggaacgggcgtggngtggagtaggggaattctttacagtaggcgggtactacgaccaaaccgtaccaaccccgtcccgtacaaaggtacgtacgaacgtacaaccctaataccttacctaagtaacgaacgaacgttaacccgaaaacgaccctaccttaccgttaacccctacggttaaaaccggttcgttaaacgtttcccgtaagggttacccggtaacccccggcccggaccgggaaccgaaccggggtccccgttagttaacgtttacgtacgggttgaccggtaaaggttagggttctttaagggtttcgggtttttaacctccggtttaggttacctaaaggttgttaaggtttagttacgttgtttacttacggtacttacgggtttcgggaccgtaacgggtacggtacgtccgtaccgtctaacctctaaccggccctaccaccgacggtaccctccg

SEQ ID NO: 303734 - DNA, 632 bp, Homo sapiens
  misc_feature: GZ8MTXP02FL9DN.13.57.F02.1.454.CMB.2.raw
  modified_base (475)..(475): a, c, t, g, unknown or other
  misc_feature (475)..(475): n is a, c, g, or t
  modified_base (489)..(489): a, c, t, g, unknown or other
  misc_feature (489)..(489): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctgtgactccatcagcggtagtaaatggtggagttgggtccgccacgcccccgaggggaaaggggctgggaggtggagttaggggaaattcttttacgattaggcgggtatcgaaccaacctaccaaccccgtccctacaagacgtcgagtcacatatctatagacaagtacagaaccacttctaccctgaacgtgagttctgtcgaccgcgacgacgacggcgtgtatactgcgacgagaggtnttggttgttttacncgttgttacaagttgtagtttattattcgttactttgactttagggttcggggaccctaacggggtaaccccgttggtacccgtaacccggttcctacccgtcgaccggtccccttacccgaaacccgtacgggggtaccccc

SEQ ID NO: 303735 - DNA, 729 bp, Homo sapiens
  misc_feature: GZ8MTXP02JJ6A0.13.57.F02.1.454.CMB.2.raw
  modified_base (456)..(456): a, c, t, g, unknown or other
  misc_feature (456)..(456): n is a, c, g, or t
tcagtcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactgggtgaagccttcggggaccctgtcctaaattgcgctgtctctggtcgactccatcagcggtagtaaagtggtggtagttgggtcccgcgacgcccccgaggggaaggctggagtggagttggggaaatcgtttcagtaggtcgggatcgaaccctaactaccgtaaccccgtccctacgaagacggtcgaacgtccacctatactacctagtaagacaagtccaagaaccctacttacctccccgtagtaaccgtgtaagtttccnggttacggaaccccgcccggcgggaacccgtacgggaccccggttaggtttacttaacgtcggttaggaccggaggtaagggtacgttttggttacggggtttttactccggttaggttacccgaaagttaggtaagtttaccgtttaagttcggttcgttttaggtaccgtttagggttaccgggttccgaaacggggttaccccgttcgggtcccgttaacgttccctacgtccgttaacgcccgtttacccaacggaaccgggttccccg

SEQ ID NO: 303736 - DNA, 522 bp, Homo sapiens
  misc_feature: GZ8MTXP01D992X.44.41.D08.1.454.CMB.2.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagacagtatatacacgaccggtgctcgatttagtcacgcgagaaagggaaaggggaggaactgctcagttaggacccagagggaaccatggaagcccagctcagcttctcttcctcctgctactctggctcccagataccaccggggaaattgtgttgacacaatctccagccacctgtctttgtctccaggggaaanagccaccctctcctgcagggccagtcagagtgttagactacttagcctggtatcaacagacactggccaggctcccaggctcctcatctatgatgcatccaataggggccgcgggcatcccagccaggttcagtggcaggtcgggtctgagacagaacttcnctcncaccatcagcgctagngcggagatttgctagttattactgtacaacacgtagcgtacgtcggtaccgtaggtacgtagtttcggccgtaggggaccgaagcgtaggacgctaacaaacgactgttgctgcncatctnttctcncttcttcccgctc

SEQ ID NO: 303737 - DNA, 514 bp, Homo sapiens
  misc_feature: GZ8MTXP01BMDLT.44.41.D08.1.454.CMB.2.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
  modified_base (488)..(488): a, c, t, g, unknown or other
  misc_feature (488)..(488): n is a, c, g, or t
tcagacagtatatacacgaccggtgctcgatttagtcacgcgagaaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggactacttagcctggtatcaacagacacctggccaggctcccaggctcctcatctatgatgcatccaataggggccncgggcatccccagccaggttcagtggcagtgggctgagacagaacttcnctctcaccatcagcggcctagagccggagatttgctagtttattactgtcaacacgtagcgacgtggcctaggtacagtttggcgaggggaccaagctggagctcaaacgaactgttggctgcnccatctgtcttcattctcccgctaac

SEQ ID NO: 303738 - DNA, 635 bp, Homo sapiens
  misc_feature: GZ8MTXP01D678N.44.41.D08.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (597)..(597): a, c, t, g, unknown or other
  misc_feature (597)..(597): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccagggggaaancgcccaccctctcctgcagggccagtcagngtgttagactattagctggtatcaanagacaccgtggccaggcctcccaggcctcctcatctatgatgcatccaaagtcggggcccgacgggcactccccgagccgtagggttcaggtggctaggttcggggtactaggacgacaggtaacctttccaacttcctaccaaccctatccgacggccgggtacctaggacgaccgggtaaagttagtttgtacgttaagttttattacgttcgtacaaccgtaccgtagacgtacgggtcggtaccgttaacggtacgttacggtttcgggaccggtaacggggaaccaggtccgtaggacgtctaacgaaacgttacgtaggttcggctcgccncttactcttcgttcttctacttccgttcccgccgtaac

SEQ ID NO: 303739 - DNA, 445 bp, Homo sapiens
  misc_feature: GZ8MTXP01A3YYM.44.41.D08.1.454.CMB.2.raw
  modified_base (440)..(445): a, c, t, g, unknown or other
  misc_feature (440)..(445): n is a, c, g, or t
tcagacagtatatacacgaccggtgctcgatttagtcacgcgagaaagggaaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaaggcccatcggtcttccccctggccaccctcctccaagacgcactctgggggcaacagcggccctgggctgcctggtcaaggactactcctatatactgtctgagcgggctggcaaggcgcgatagnnnnnn

SEQ ID NO: 303740 - DNA, 568 bp, Homo sapiens
  misc_feature: GZ8MTXP01C75QG.44.41.D08.1.454.CMB.2.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctntcctgcagggccagtcagagtgttaggaactacttagcctggtatcaacagaccacctggccaggctcccaggctcctnatctatgatgcatccaagtgggccgcgggcactcccagccaggttcagtggcaggtcgggtctggagacagtaccttcaactctaccacccatcagggccggactagacgcggaagtagtttgacttagtttattacgtgtacaacgtacgtagccgacgtcggtcgttacggtacgtaggtttcggccgaggggaaccaaggtcgtagggacgctaacgaaacgacgtgttaggctgcgttacatcgtctcttctacttcccgttcccgcctaac

SEQ ID NO: 303741 - DNA, 537 bp, Homo sapiens
  misc_feature: GZ8MTXP01CMAPZ.44.41.D08.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaangccaccctctcctgcagggccagtcagagtgttagactacttagcctggtatcaacngacacctggccaggctcccaggctcctcatctatgatgcatccaatgggccncgggcatcccagccaggttcagtggcagtcgggtctgagacagaacttcnctctcaccatcagcgctagagcggagtntttgctagtttattactgtacaacgacgtagcgacgtggccgtaggtacgtagtttcggccgtaggggaccagtcgtaggacgctaacgaaacgacgtgttcggcgtcggacnccacttctgttcttctacttccttcccgcctaacg

SEQ ID NO: 303742 - DNA, 597 bp, Homo sapiens
  misc_feature: GZ8MTXP01A72AR.44.41.D08.1.454.CMB.2.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
  modified_base (553)..(553): a, c, t, g, unknown or other
  misc_feature (553)..(553): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaattgtgttgacacaatctccagccaccctgtctttgtctccgagggaaancgccaccctctcctgcagggccagtcagagtgttagaactacttagcctggtatcaacagacactggccaggcctcccaggcctcctcatctatgatgacatccaagtcgggcccgngggcactccccgagcccgtaggttccaggtggcgaggtcggggtctggagacagtaaccttcaactcctacaccctatcgagccggaccgtagacgaccggtaagtatttgacttagtttacttacgtcgtacaactaccgtagcgtacgtcggtacgtaggtacgtaggtttcggcgacggggaccagtcgtaggtacgcgtaacgaacgttaacgtcggttcggtctcgacnccgttacttcctagttccttctacttcccgttcccgcgttaacg

SEQ ID NO: 303743 - DNA, 662 bp, Homo sapiens
  misc_feature: GZ8MTXP01ECYQN.44.41.D08.1.454.CMB.2.raw
  modified_base (206)..(206): a, c, t, g, unknown or other
  misc_feature (206)..(206): n is a, c, g, or t
  modified_base (259)..(259): a, c, t, g, unknown or other
  misc_feature (259)..(259): n is a, c, g, or t
  modified_base (392)..(392): a, c, t, g, unknown or other
  misc_feature (392)..(392): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgttctttgtctccgaaggggaaancgcccaccctctcctgcaggccagtcagagtgttagactatagctgtatcaanagacactggccaggctcccagctcctcatctatgatgcaatccaagtacggggcccgtcgggacactccccgagccctagggttcaggtggcgaggttcgggactgagacagtaaccttcaactctacaaccngtacacggcgtactagacggtaccggtaagtattttcggacttaagttttacttacgtacgtaccgaaacgtacgtacgtccgtacgggtcggtaccgttaacggggttactttacggggttttcggacccggtaaacgggggtaacctaagggtaccgtagggaccgtaccgtaaacggtaaaaccggttacggtacggttcggaccttaggacccttacgttaacttccttacgttcttccgtacttccccttcccgttaaccttaag

SEQ ID NO: 303744 - DNA, 499 bp, Homo sapiens
  misc_feature: GZ8MTXP02JNWKU.44.41.D08.1.454.CMB.2.raw
  modified_base (202)..(202): a, c, t, g, unknown or other
  misc_feature (202)..(202): n is a, c, g, or t
  modified_base (496)..(496): a, c, t, g, unknown or other
  misc_feature (496)..(496): n is a, c, g, or t
tcagacagtatatacacgaccggtgctcgatttagtcacgcgagaaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttagaactacttagcctggtatcaacagacacctggccaggctcccaggctcctcatctatgatgcatccaatgggccgcggcatcccagccaggttcagtgcagtgggtctgagacagacttcactctcaccatcagcgctagagcgagatttgctagttatactgtcacacgtagcgactgcctaggtactagtttgccgaggggaccaagctggagctacaaacgactgtggctgcaccatctgtcttcactcttcccnctc

SEQ ID NO: 303745 - DNA, 518 bp, Homo sapiens
  misc_feature: GZ8MTXP02I4BI6.44.41.D08.1.454.CMB.2.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagacagtatatacacgaccggtgctcgatttagtcacgcgagaaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaaangccacctctcctgcagggccagtcagagtgttaggaactacttagcctggtatcaacagacacctggcccaggctcccaggctcctcatctatgatgcatccaatgggccnggcatccccagccaggttcagtggcagtgggtctgagacagacttcnctctcaccatcagcgcctagagccgagtatttgctagtttatactgtcaacaccgtagcgtactggtcctaggtactagtttcggcctaggggaccaagctaggagctacgaaacgaactgcggctcgacacatcgtgtcttcacttccttccgctac

SEQ ID NO: 303746 - DNA, 526 bp, Homo sapiens
  misc_feature: GZ8MTXP02IC5QG.44.41.D08.1.454.CMB.2.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
  modified_base (361)..(361): a, c, t, g, unknown or other
  misc_feature (361)..(361): n is a, c, g, or t
tcagacagtatatacacgaccggtgctcgatttagtcacgcgagaaagggaaaggggaggaactgctcagttaggacccagagggaaccatggaagccccagctcagcttctcttcctcctgctactctggctcccagataccaccggggaattgtgttgacacaatctccagccacctgtctttgtctccaggggaaangccacctctcctgcagggccagtcagagtgttagaactacttagcctggtatcaacngacacctggccaggctcccaggctcctcatctatgatgcatccaaatcggggccgcgggcatcccagccaggttcagtggcagtcgggtctgagacagacttcnctctcaccatcagcgctagagcggaagatttgctagtttattactgtacacacgtagcgacgtggtcctaggtactagtttggcgaggggacaaggcgtagggagtactacgaaaacgtacgtgtacggctcgcaccatcgtgtcttcacttccttccgacctac

SEQ ID NO: 303747 - DNA, 535 bp, Homo sapiens
  misc_feature: GZ8MTXP02FV7PJ.44.41.D08.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaacagacacctggccaggctcccaggctcctcatctatgatgcatccaatagggccncggcatcccagccaggttcagtgcaggtggtctgagacagacttcactcncaccatcagcggcctagagccggaagtatttgctagttattactgtcaacacgtancgactcggctagtactagtttcggcgaggggaccaagcgtaggagctacgaaaacgtaacgtcggtaggactcgaccaccaacttcttcgtcttctacttccttcccgtcctac

SEQ ID NO: 303748 - DNA, 531 bp, Homo sapiens
  misc_feature: GZ8MTXP02HFYL8.44.41.D08.1.454.CMB.2.raw
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagacagtatatacacgaccggtgctcgatttagtcacgcgagaaagggaaaggggagtcagacccactcaggacacagcatggacatgagggtccccgctcagctcctggggcttctgctgctctggctcccaggggacagagtcaccatcacttgccgggcaagtcagggcataaacagtgctttggcctggtatcagcagaaaccagggaaaactcctgaactcctgatctatgatgcctcagttgaaagtggatcccatcaaggtcagcggcagtggatcgnggacagattcactctcaccatcagcagctgcagcctagaatattttgcaactttattacngtacagactatttaaactacttaaccctntctactttcgggcgaagggaccaagggtggaagaatacaaacgaactagtgcgtgacacactctcgtcttctactcctccctacctactactactataactacttacttacgtcgtacgacggcggtcgtacggtacgaacggacgacgacgtag

SEQ ID NO: 303749 - DNA, 539 bp, Homo sapiens
  misc_feature: GZ8MTXP02GMNZ6.44.41.D08.1.454.CMB.2.raw
  modified_base (201)..(201): a, c, t, g, unknown or other
  misc_feature (201)..(201): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagacagtatatacacgaccggtgctcgatttagtcacgcgagaaagggaaaggggaggaactgctcagttaggacccagagggaaccatggaagccccagctcagcttctcttcctcctgctactctggctcccagataccaccggggaaattgtgttgacacaatctccagccaccctgtctttgtctccaggggaanagccaccctctcctgcagggccagtcagagtgttaggaactacttagcctggtatcaacagacacctggccaggctcccaggctcctcatctatgatgcatccaataggccgcggcatcccagccaggttcagtggcagtcggtctgagacagacttcactcncaccatcagcgctagngccgaagtatttgctagtttatactgtacaacacgtagcgactcggacctaggtacgtagttttcggaccgtaggggacccaagccgtgggtacgcgtacgaaaacgaactcggtaggactcgaccaccgatccgtgtcttcacttccttacccgctac

SEQ ID NO: 303750 - DNA, 505 bp, Homo sapiens
  misc_feature: GZ8MTXP02G37TZ.44.41.D08.1.454.CMB.2.raw
  modified_base (201)..(201): a, c, t, g, unknown or other
  misc_feature (201)..(201): n is a, c, g, or t
  modified_base (365)..(365): a, c, t, g, unknown or other
  misc_feature (365)..(365): n is a, c, g, or t
  modified_base (414)..(415): a, c, t, g, unknown or other
  misc_feature (414)..(415): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaaagtacctagcctggtaccaacagaaacctggccaggctccagctcctcatctatgatgcatcaaacaggtcactgcacccagacaggttcagtggcagtgggtctgggacagacttcactctnaccgtcagcaaatgtacagcctgaagattttgcagtttaatactgtcannagctctcagcgctctacgtcggcggggacggaggagagagtacagacgaacgtagtcgcgtcgacacaactctcgtctctactctcctcc

SEQ ID NO: 303751 - DNA, 446 bp, Homo sapiens
  misc_feature: GZ8MTXP02IS154.44.41.D08.1.454.CMB.2.raw
  modified_base (442)..(446): a, c, t, g, unknown or other
  misc_feature (442)..(446): n is a, c, g, or t
tcagacagtatatacacgaccggtgctcgatttagtcacgcgagaaagggaaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaaggaccacggtcaccgtctcctcagcctccaccaaggcccatccggtcttccccctggccaccctcctccaacgacgcacctctggggcacagcggccctgggcctgcctggtcaagggactacttcttatatactgtctgagcgggctggcaaggcgcatagnnnnn

SEQ ID NO: 303752 - DNA, 573 bp, Homo sapiens
  misc_feature: GZ8MTXP02FZ6E1.44.41.D08.1.454.CMB.2.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
tcagacagtatatacacgaccggtgctcgatttagtcacgcgagaaaggggaaagggggaggaactgctcagttaggacccagagggaaccatggaagccccagctcagcttctcttcctcctgctactctggctccagataccaccggggaattgtgttgacacaatctccagccaccctgtctttgtctccgaggggaaangcccaccctntcctgcagggccagtcagagtgttagactacttagcctggtatcaangacactggccaggctccaggctcctcatctatgatgcatccaagtcgggccgcgggcactccccgagccctagggtttcaggtgggccaggttcggggtctggaagacagacctttcgactctcaaccatcgaaggtccgacctagacgacggtaagtatttgcttagtttattactcgtacaacgacgtagcgacgtcggaccgtaggtactagtttcgcgtagggaccgtaagcgtaggacgactacgaaacgtacgtggtcggtactcgaccacctactcgtcgttctactacttccctacccgtctacg

SEQ ID NO: 303753 - DNA, 528 bp, Homo sapiens
  misc_feature: GZ8MTXP02JX0GA.44.41.D08.1.454.CMB.2.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (495)..(495): a, c, t, g, unknown or other
  misc_feature (495)..(495): n is a, c, g, or t
  modified_base (506)..(506): a, c, t, g, unknown or other
  misc_feature (506)..(506): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggaactacttagcctggtatcaacagacacctggccaggctcccaggctcctcatctatgatgcatccaagtcggggccgngggcatccccagcctaggttcagtggcaggtcgggtctgagacagacttcactcncaccatcagtcgctagagccggaagtntttgctagttattactgtacacaccgtagcgacgtggcctaggtactagtttggccgtaggggaccaaggcgtggacgctacgaaacgactggngcgtcgcacgntcgtgtctcactcttccgctac

SEQ ID NO: 303754 - DNA, 534 bp, Homo sapiens
  misc_feature: GZ8MTXP02IJA57.44.41.D08.1.454.CMB.2.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaangccacctctcctgcagggccagtcagagtgttaggaactacttagcctggtatcaacagacacctggccaggctcccaggctcctcatctatgatgcatccaagtacgggcccgngggcatccccagccaggttcagtggcaggtcgggtctgagacagtacttcactctcaccatccaggccgacctagacgaccggaagtatttagctagtttattactgtacaacacgtagcgacgtggtaccgtagtactagtttggcgagggacagcgtggagctacgaaacgactcgtaggctcgacacatcgtcgtctctactcctccgctacg

SEQ ID NO: 303755 - DNA, 578 bp, Homo sapiens
  misc_feature: GZ8MTXP02GP5YD.44.41.D08.1.454.CMB.2.raw
  modified_base (203)..(203): a, c, t, g, unknown or other
  misc_feature (203)..(203): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggaactattagcctggtatcaacagacacctggccaggcctcccaggcctcctcatctatgatgcatccaaagtacggccgcgggcatcccagccaggttcagtggcaggtcgggtctgagacagtacttcacttcacaccatcgaagccggacctagacggacggaagtatttgactagtttattacgtgttacaacctacgtagacgacgtcggccgttaggtacgtaggttttcggaccgaagggggacccaaaggccgtaggacgacgtacgaaaacgtaacgtacggtggctacgacaccactctcgttccttacacttccttcccgaccttacg

SEQ ID NO: 303756 - DNA, 594 bp, Homo sapiens
  misc_feature: GZ8MTXP02GQOCY.44.41.D08.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (360)..(360): a, c, t, g, unknown or other
  misc_feature (360)..(360): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaattgtgttgacacaatctccagccaccctgtctttgtctccgaggggaaangcccaccctctcctgcagggccagtcagagtgttaggaacttacttagccttggtatcaanagacaccgtggccaggcctcccaggcctcctcatctatgatgcatccaagtacggccgcggcatcccagccaggttcagtgcaggtcgggtctganacagaccttcactctacaaccatccgagccgcctaagacgaccggtaagtagtttgacgttagtttattactgtactaaacgacgttacgcgacgtcggaccgtaaggtacgtaggttttacggccggtaaggggaaccctaaggtccgtaggggacgtaccgtaaccgaaaacgtaccgtggtcggacgtcgacaacccgatcgtcgttctactacttcctacccgtctaacg

SEQ ID NO: 303757 - DNA, 579 bp, Homo sapiens
  misc_feature: GZ8MTXP02G9C1R.44.41.D08.1.454.CMB.2.raw
  modified_base (202)..(202): a, c, t, g, unknown or other
  misc_feature (202)..(202): n is a, c, g, or t
tcagacagtatatacacgaccggtgctcgatttagtcacgcgagaaagggaaagggggaggaactgttcagttaggacccagagggaaccatggaagccccagctcagcttctcttcctcctgctactctggctcccagataccaccggggaaattgtgttgacacaatctccagccaccctgtctttgtctccaggggaangccaccctctcctgcagggccagtcagagtgttaggaactacttagcctggtatcaacagacacctggccaggctcccaggctcctcatctatgatgcatccaagtagggccgcgggcacgtccccagcccaggttccaggtggcaggtgggtcctggagacagacttcactctcaccatccagcgacctagacgcgaagtatttgctagtttattactgtacaacgtacgtagacgtactcggtaccgtaggtacttaggtttcggaccgtacggggaccgaaggtccgtagggagacgtacgtaaacgtaacgtaggtcggtactcggaccaactcttcgtcgttcttcctacttcccttcccgtcctacttccg

SEQ ID NO: 303758 - DNA, 667 bp, Homo sapiens
  misc_feature: GZ8MTXP02JFCN2.44.41.D08.1.454.CMB.2.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (369)..(369): a, c, t, g, unknown or other
  misc_feature (369)..(369): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaattgtgttgacacaatctccagccacctgtctttgtctccgagggggaaancgcccaccctctcctgcagggccagtcagagtgtagaactcttagcctggtatcaacagacnccgtggccaggcctcccgaggtcctcctacatctatgatgcactaccaagtcggggccgcgggcactccccagtccgaggttcaggtggacgtaggtcgggtcnggaacacgtagtaccttcgaccttctaccaacctatccgaacggtccggaccgttaaggacggtaccggtaaagttacgtttgacgttatttacgttacgttacgtaacctaaacgtaccggtaagtaccgtaacgtcggtacccgttaaggttacgttacggtttacggggaccgtaacgggggtaaccgaacggtcgtagggtaacggaccttaacgaaaacggtaacttgggtaccgacgttacgaccaactagttccgtacttccttaccgtacttcccgtttacccgcttacg

SEQ ID NO: 303759 - DNA, 527 bp, Homo sapiens
  misc_feature: GZ8MTXP01DTT4M.11.38.D05.1.454.CMB.2.raw
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
tcagcgagagataccacgaccggtgctcgatttagtatctgatagttgggtttggggaggcttggtacagcctgggggtccctgagactctcctgtgcagcgtctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaaatgcgatatatctacagatgaaacagcctgcgagccgaggacaggctgtntattactgtgggagtccctggctggcaccctgtatccgacgttggaagtcngggactctggtcaccgtctcctcacgcctccacaagggcccatccggtcttcccctcgccgccctcgctcccgagggcgcaccctccgagcgcacagccggcccgtgggctgccctggttcaaggctacttccgttattcttctcgctgcgcgggctggcgaaggg

SEQ ID NO: 303760 - DNA, 562 bp, Homo sapiens
  misc_feature: GZ8MTXP01CIFW1.11.38.D05.1.454.CMB.2.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (393)..(393): a, c, t, g, unknown or other
  misc_feature (393)..(393): n is a, c, g, or t
  modified_base (542)..(542): a, c, t, g, unknown or other
  misc_feature (542)..(542): n is a, c, g, or t
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccgagggaaggggctggagtgggtctcagctattagtgatagtggtggtagcaacatactacgnagactccgtgaagggccgttcaccatctcaganacaattccatgaacacgctgatctgacaaaatgaaacagcctganacgccgagacacggctatattacngngcganagatagtagttggtagtggtgagctgcgtacggtcggggaccacggtaccctggtacctaccgtctcncacgccctaccgaccgaacggccctacgtcccgtcccttccccgtcgaccctaccctcgtaccgaagcgccgaccgtcggcgggacacgacggtccggccgtcgggctcgccgttaggtacaacgtaccttacgttccgttcttcctcncgcgtggcggcggtcgcgcg

SEQ ID NO: 303761 - DNA, 639 bp, Homo sapiens
  misc_feature: GZ8MTXP01A4C47.11.38.D05.1.454.CMB.2.raw
tcagcgagagataccacgaccggtgctcgatttagtatctgatagttgggtttgggggaggcttggtacagcctgggggggtccctgagactctcctgtgcagcgtctggattcacctttagcagctatgccatgacctgggtccgccaggctccgagggaaggggctgggagtgggtctcagctattagtgataggtggtggtagcacatactacgcagactccgtgaagggccgttcaccatctcagagacaattccatgaacacgctgatctgacaaatgaacagcctgagagccgaggacacggcgtatatactgtgcgcagatagtattggtagtgggtaggtagcttgcgttacggtcgggggacccaacggggtaaccccttggggaccctacccggtcctcccgtcgacgccctacccacccgaacgggcccctacgttcccgggttcccttcccccgtcggaccctaccccgtcccgtaccgaacgaccgcctaccgtccggtcgggggccaccgacgggtcccggtcccggtcgggccgtcggtccgttacgggtaccgaaacgggtacccttacgttaccgttacttccgtcgttaccgcgttggacggcgggtcgttcgggaaccgg

SEQ ID NO: 303762 - DNA, 523 bp, Homo sapiens
  misc_feature: GZ8MTXP02GKHHO.11.38.D05.1.454.CMB.2.raw
  modified_base (283)..(283): a, c, t, g, unknown or other
  misc_feature (283)..(283): n is a, c, g, or t
tcagcgagagataccacgaccggtgctcgatttagtatctgatagttgggtttggggaggcttggtacagcctgggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacngcctgagagccgaggacacggccgtatattactgtgcgcagatagattgagtggtgtagcttgctacgtggggccaggggaccctgggtcaccgtctcctcagcctccaccaacgggcccatccggtccttccccctcggccacccctcctcccaagacgccacctcgtgggggcacgacgccggccctgggctcgcctggtcaaaggctactccgtatctcgtcgctgagcggctggcg

SEQ ID NO: 303763 - DNA, 518 bp, Homo sapiens
  misc_feature: GZ8MTXP02I2K5P.11.38.D05.1.454.CMB.2.raw
tcagcgagagataccacgaccggtgctcgatttagtatctgatagttgggtttggggaggcttggtacagcctgggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccgttcaccatctccagagacaattccatgaacacgctgtatctgcaaatgaacagcctgagagccgaggacacggccgtatattactgtgcgcagatagattgtagtggtggtagctgctactgggggccagggaaccctgggtcaccgtctcctcacgcctccaccaaggcccatcggtcttccccctcggccaccctcctccaagacgcaccctcgtgggggcacgacgcggccctgggctcgcctggtcaaggactacttccgtatctctcgctgagcggctggacg

SEQ ID NO: 303764 - DNA, 552 bp, Homo sapiens
  misc_feature: GZ8MTXP02F8MH1.11.38.D05.1.454.CMB.2.raw
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctacgtgggggccaggggaaccctggtccaccgtctcctcacgcctccaccaacgggcccagtccggtccttccccctcggcccacccctcctcccaagacgccaccctcgtcgggggcacgacgccggcccgtgggcctcgccgtggtcgaacggacctaccgttccgtactcctcgtcgcgtcgacggcgggcgtcggacg

SEQ ID NO: 303765 - DNA, 588 bp, Homo sapiens
  misc_feature: GZ8MTXP02JD76V.11.38.D05.1.454.CMB.2.raw
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctacgtgggggccaggggaccctggtcaccgtctcctcacgcctccaccgaacggcccacgtccggttccttcccccgtcgcccacccctcctacccaagacgccacctcgtcgggggccacgacggcccggcccgtcggggcctcggcccgtgggtaccgaaacgggtaaccttaccgtttacccggtacttcccgtccgttccggtccgtcggacggccggggtcgtacgggaccgg

SEQ ID NO: 303766 - DNA, 548 bp, Homo sapiens
  misc_feature: GZ8MTXP02FPLSC.11.38.D05.1.454.CMB.2.raw
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccgttcaccatctccagagacaattccatgaacacgctgtatctgcaaaatgaacagcctgagagccgaggacacggctatattactgtgcnagatagattgtagtggtggtagctgctacgngggggccaggggaccctggtccaccgtctcctcacgcctccacccgacggcccatccggtcccttcccccgtcgcccacccctccctacccagcgccacctcgtcgggggcacgacgccggccgtgggctcgccgtggtcaacggtacctaccgttccgtactcctcgtccgcgtcggaggccgggcgacggaccg

SEQ ID NO: 303767 - DNA, 600 bp, Homo sapiens
  misc_feature: GZ8MTXP02JWJB8.11.38.D05.1.454.CMB.2.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagcgagagataccacgaccggtgctcgatttagtatctgatagttgggtttgggggaggcttggtacagcctggggggtccctgagactctcctgtgcagcgtctggattcacctttagcagctatgccatgaccctgggtccgccaggctccagggaaggggctggagtgggtctcagctattagtgatagtggtggtagcacatactacgcagactccgtgaagggccgttcaccatctccaganacattccatgaacacgctgtatctagacaaatgaacngcctgagacgccgaggacacggcctatntacngtgcnagatgattgtagtggtggtanctgctacgnggggccagggaccctgggtccaccgtctcctcacgccctccaaccgaacgggccccagtcccggtaccttcccccgtcggacccaccccgtcctaccgaacgacgaccgacccgtcgtacgggggaccacgacggcccggcccgtcgggccgttcggcccgttacgggtacctaaacgggtacctttaccgttacccgtaacttccgtccgtcggtacttacgggacggtccggggctcgggaaccg

SEQ ID NO: 303768 - DNA, 534 bp, Homo sapiens
  misc_feature: GZ8MTXP02ISRX0.11.38.D05.1.454.CMB.2.raw
  modified_base (288)..(288): a, c, t, g, unknown or other
  misc_feature (288)..(288): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccgaggggaaggggctggagtgggtctcagctattagtgatagtggtggtagcacatactacgcagactccgtgaagggccgttcaccatctccagagactaattccatgaacacgctgtatctgacaaatgaacngcctgagagccgagacacggctatattactgncgnagatagnttgagtggngtanctgctagngggccaggacctgcacctctccncacgccncgaccacggccacgtccggtccctccccgcgcctacccctcctaccaagcgccaccgtcggtcggggcacgcgccggccgtcgggccttcgccgtcggtacgaacggtactaccgttccgtactctcgtcgctcggacggccggcgtacgacg

SEQ ID NO: 303769 - DNA, 697 bp, Homo sapiens
  misc_feature: GZ8MTXP02ID8JG.11.38.D05.1.454.CMB.2.raw
  modified_base (146)..(146): a, c, t, g, unknown or other
  misc_feature (146)..(146): n is a, c, g, or t
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagcgagagataccacgaccggtgctcgatttagtatctgatagttgggtttgggggaggcttggtacagcctgggggggtccctgagactctcctgtgcagcgtctggattcacctttagcagctatgccatgacctgggtccnccaggctccgaggggaggggctggagtgggtctcagctattagtgattaggtggtggtagcacatactacgnagactcgtggaaggccgttcaccatctacaganactaattccananaacngntntactcagacaaancgaacngtccaggagacgcgaggaccgacggtacttaatattacgtgcgcgacgtaagtagtagtagtttaggtagggtgggtagtacgtcgtaggtaccgtacggggtcgggggacccgtaaccgggggtaccctcgggtacctacccgtaccctccgtacgaccgtcccgtacccgaacccggtaccggccctacgttcccggtcccccttccccgtaccgtacccctaccccgtaccctaaccgaacgaccgtaccgtacccggttcggggacggggacccaccgggaccggtcccgggtcccggtcgggtccgtcggtaccggtcggtaaccggtaaacggttaccttacccgtttccgtaccttccgtccgtacggtacggtcgggacgggtcgggtacgcggaacg

SEQ ID NO: 303770 - DNA, 539 bp, Homo sapiens
  misc_feature: GZ8MTXP02GUW1R.11.38.D05.1.454.CMB.2.raw
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (424)..(424): a, c, t, g, unknown or other
  misc_feature (424)..(424): n is a, c, g, or t
tcagcgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccgagggaaggggctggagtgggtctcagctattagtgatagtggtggtagcacatactacgcagactccgtgaagggccgttcaccatctcagagacaattccatgaacacgctgtatctgacaaatgaaacngcctgagngccgaggacacggctatatcngtgcanagatagattgtagtggtgagctgctacgnggggccaagggaccctggtccaccgtctcctcncgcctccaccgacggcccacgtccgtccctccccgtcgccncccctcctaccaacgacgccaccgtcgtcggggcacgacgccggccgtcggctcgccgtcggacgaacgtacttaccgttccgtactctcgtcgcgtcgacggcggcgtcgacgg

SEQ ID NO: 303771 - DNA, 803 bp, Homo sapiens
  misc_feature: GZ8MTXP02IQVW6.11.38.D05.1.454.CMB.2.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (690)..(690): a, c, t, g, unknown or other
  misc_feature (690)..(690): n is a, c, g, or t
tcagcgagagataccacgaccggtgctcgatttagtatctgatagttggggtttgggggaggcttggtacagcctgggggggtccctgagactctcctgtgcagcgtctggattcacctttagcagctatgccatgacctgggtccgccaggctccgaggggaaggggctggagtgggtctcagctattagtgataggtggtggtagcacatactacgnagacctcggtggaacgggtccggttcacctatcctaccaganacaacttccatacgaacacgtctgttatctacgactaaaatcgaaacagccgtaggaaggaccggaccggtaacgggaacccgtaaccggtaccgtttaaaattaccgttttaaaccgtggggttcggaccgtaacgtaaggttaagtaaggttaagtttttggggtaagggtttgggggttaggggttacgtccggttcggtacccgggttaagggggttcccggggggaacccccggtaaaaccgggggtacccccggtttgggtaaaccccgtacccccgttcccttccccaccgtacccgtacccctaccccggaaaccggaaacccggggtcccctaccggtttaccccgttccccgttacccccgtcggtacccctacccccgtccaaccgacgaccgtccgtaccgtcgggtccggggaccncggaccggtccggtccgtcgggtcgtccggtcggtacggtaccgtaaacgtcccgttaccttccgttacttcctaacgtcgtacgtcggagggtcccggcggtacgggaacgg

SEQ ID NO: 303772 - DNA, 499 bp, Homo sapiens
  misc_feature: GZ8MTXP01EB3CG.45.5.A05.1.454.CMB.2.raw
  modified_base (226)..(226): a, c, t, g, unknown or other
  misc_feature (226)..(226): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggancctcttacatacaaatggaaagacttattgtactggacctgcagagccaggccagtcgccgcagctcctagtccagcaggcttccagccgttccnggatcgtcagacaggttcaagtggcaggntcagacacattctttcactctagaaatcagccgtgtggcgctgaggatgttggggttgtttatactgcatgnaagctaggtagaccggtacaaccgtttgggccgggggaccagggctgggagttcagtgaactgtggcttgcnccgtn

SEQ ID NO: 303773 - DNA, 505 bp, Homo sapiens
  misc_feature: GZ8MTXP01DJ2JP.45.5.A05.1.454.CMB.2.raw
  modified_base (223)..(223): a, c, t, g, unknown or other
  misc_feature (223)..(223): n is a, c, g, or t
  modified_base (321)..(321): a, c, t, g, unknown or other
  misc_feature (321)..(321): n is a, c, g, or t
  modified_base (505)..(505): a, c, t, g, unknown or other
  misc_feature (505)..(505): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagacttatttgtactggacctgcagagccaggccagtcgccgcagctcctagtccagcagggcttccagccggttccnggagtcgtcagacaggttcaagtggcacggatcagacacatctttcactctagaaatcagcgtgtcggcgctgaggatggttggggttgtttattactgcatgcaagtctgtacgaccggtcaaccgtttgggccgggggtaccagggcgtggaggttcaatcgaactgtggcttgcaaccgtn

SEQ ID NO: 303774 - DNA, 535 bp, Homo sapiens
  misc_feature: GZ8MTXP01AZ0ZH.45.5.A05.1.454.CMB.2.raw
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (425)..(425): a, c, t, g, unknown or other
  misc_feature (425)..(425): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcgtggtttcctgcgtattatataaaggtgtcctgtgtcaggtacagatggcggagtcgtgggggaagaacggtcaacccgtggcggtcctgagctctctgttaggtctggattcgtcttcagcgactacacctgagttgggccgntggctccgagggaagngtctggagtggattgcgtacatcagtcattcngacttccgacgtctactacgaccagctctgggtggacgggcccattcacctacttccgaggacgacgccgacgaactctacttanctgcagatgggactagtctgagacccgagaccacgccatactactactgtgcgcgaggtagttacgttggcgttccgtggggcccgaaccgtcggtcaccggtccgcgcg

SEQ ID NO: 303775 - DNA, 518 bp, Homo sapiens
  misc_feature: GZ8MTXP01ARURS.45.5.A05.1.454.CMB.2.raw
  modified_base (223)..(223): a, c, t, g, unknown or other
  misc_feature (223)..(223): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtacttattgtactggtacctgcagaggccaggccagtcgccgcagctcctagtccagcagggcttccgagtccgttactggagtcgtcagacaggttaagnggacncggatcagacacattcttcactactagaaatcagccgtgtcggccgctgagtatgttggttggtttattactgctatgcaagtctagtacgaccggtacgtccgtttcgggccgggggacgacggcgtgggaggttcgagttcgaacgtgtggctggctccgaatcg

SEQ ID NO: 303776 - DNA, 499 bp, Homo sapiens
  misc_feature: GZ8MTXP01A9847.45.5.A05.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (317)..(317): a, c, t, g, unknown or other
  misc_feature (317)..(317): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcacccctgggcagtcggccgccatctcctgcacgtctagtcgagcctnttacatacaaatggaaancttattgactggacctgcagaggccaggccagtcgccgcagctctagtccagcaggcttccagccggttccnggatcgtcagacaggttcaagtggcacgggatcagacacattcttcactctagaaatcagccgtgtgccgctgagatgttgggtgtttattactgcatgcagctgtagacggtacgtaacgttcggcggggaccgaggcgtggaggttcgacgtaacgacgtgtggcgttcgtcgccgtaag

SEQ ID NO: 303777 - DNA, 566 bp, Homo sapiens
  misc_feature: GZ8MTXP01D001O.45.5.A05.1.454.CMB.2.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgtttaggttctgggatttcgtcttcagcgactactacctgagttgggtccgctggctcgagggaagngtctggagtggattgcgtacatcagtcattctgtacttccgacgtntactcgacagctntggtggagggccattcactattccgaggacgacgccgacgaactctacttactctgcagatggactagtctagagacccgagacacgctatatactctgtgcgcgaggtagtttaacgttcggttcgttacccggtcgggggaccccgggtaacccgtcggtccgttaccgtccgttccggaacccg

SEQ ID NO: 303778 - DNA, 596 bp, Homo sapiens
  misc_feature: GZ8MTXP01AFQZQ.45.5.A05.1.454.CMB.2.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtccggccgccatctcctgcacgtctagtcggagcctcttacatacaaatggaaagacttattgtactggtacctgcagaggccaggccagtcgcgcagctcctagtccagcagggcttccgaggtcccggttcctggagtcgtacagacgtaggttcaaaggtcgggaacacgggactacagaccactattcctttacactactagaaaactcaggcccgtgtcggccgcgtagaggtattggttaggggttgtttaacttactacggtctagtgaccgtaagtcttacggtacggtacccggtacgtaacccggtttcgggggacccggggtaccagggtccgtagggaggttccgttaagtaacccggtagtcggtacgggtcttcggaaccaaccgttaacg

SEQ ID NO: 303779 - DNA, 510 bp, Homo sapiens
  misc_feature: GZ8MTXP01A6LMA.45.5.A05.1.454.CMB.2.raw
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctggcagtcggccgccatctcctgcacgtctagtcggagcctnttacatacaaatggaaagcttattgactggtacctgcagaggccaggccagtcgcgcagctctagtccagcaggcttccagccgtacnggatcgtcagacaggtaagnggacncggatcagacacatctttcactctagaaatcagccgtgtcggcgctgagtatgttggtggtttattacgtgcgtatgacaagctgtagaccggtacaccgttgggccgggggttaccagggcgtgggacgttacgagttcgaactggtaacggctgctaaccgttaattcg

SEQ ID NO: 303780 - DNA, 561 bp, Homo sapiens
  misc_feature: GZ8MTXP01B5XIL.45.5.A05.1.454.CMB.2.raw
  modified_base (313)..(313): a, c, t, g, unknown or other
  misc_feature (313)..(313): n is a, c, g, or t
  modified_base (441)..(441): a, c, t, g, unknown or other
  misc_feature (441)..(441): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccctggcgggtcctgaggctctctgttagtctggattcgtcttcagcgactactacctgagttgggtccgctggctccgagggaagngtctgggagtggattggcgtacatcagtcattctgacttccgacgtctactacgcagctctggtgggacgggtcctattccaaccctagtttccgaggggaccgacggcccgacgaactctactttanctgcagatcggactagtctgacgacccgaagaccgacggcctatatatctgtgcgcgaggtagttacgttggcgttccggtggggaccccgggaaccgtcggccgaccgtcgttccgccg

SEQ ID NO: 303781 - DNA, 510 bp, Homo sapiens
  misc_feature: GZ8MTXP01CR8Z5.45.5.A05.1.454.CMB.2.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (320)..(320): a, c, t, g, unknown or other
  misc_feature (320)..(320): n is a, c, g, or t
  modified_base (393)..(394): a, c, t, g, unknown or other
  misc_feature (393)..(394): n is a, c, g, or t
  modified_base (408)..(408): a, c, t, g, unknown or other
  misc_feature (408)..(408): n is a, c, g, or t
  modified_base (414)..(415): a, c, t, g, unknown or other
  misc_feature (414)..(415): n is a, c, g, or t
  modified_base (417)..(417): a, c, t, g, unknown or other
  misc_feature (417)..(417): n is a, c, g, or t
  modified_base (462)..(462): a, c, t, g, unknown or other
  misc_feature (462)..(462): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctnttacatacaaatgaaatcttattgactggactgcagagccaggccagtcgccgcagcctcctagtccagcaggtcttccgagtcccggttccnggatcgtcaggcaggttcaaggtgaacagggatcgagacactatctttcactactagaaatcagcgtgtggcnngagtatgttggttntttatnncntgacagtctagtacgaccggtcgtaaccgttggggccggggacgnggacgtgggaggttcaagtcgaacgtggtggcttgtccgaacgtaacg

SEQ ID NO: 303782 - DNA, 589 bp, Homo sapiens
  misc_feature: GZ8MTXP01CIZU2.45.5.A05.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (344)..(344): a, c, t, g, unknown or other
  misc_feature (344)..(344): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcacccctggcagtcgccgccatctctgcacgtctagtcgancctntacatacaaatggaaatacttattgtactggtacctgcagagcaggccagtcgcgcagctcctagccagcaggcttccagccgttcctggagtgtcacgacaggttcagtggaaacacggntcaagacactatctttcactctagaaatcagcgtgtcggccgtcgtgagtattggttgttagtttagttacgtggtcagttgacgaaagtcgttaggtacggtacccgggttaccgtaccgggtttcggggaaccccgggggtaccgaggggtaccgttaggggtaacggttacgaaacggttccggttaaaccgttgggtacgggtccgttacggacccttaaccgtaacgtttccgtttccgg

SEQ ID NO: 303783 - DNA, 619 bp, Homo sapiens
  misc_feature: GZ8MTXP01AJCPR.45.5.A05.1.454.CMB.2.raw
  modified_base (219)..(219): a, c, t, g, unknown or other
  misc_feature (219)..(219): n is a, c, g, or t
  modified_base (318)..(318): a, c, t, g, unknown or other
  misc_feature (318)..(318): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggtatttagtacggacattgcggtgacccagactccactctccctgtccgtcacccctggcagtcgccgccatctctgcagtctagtcgancctcttacataacaaatggaaatcttattgactggacctgcagaggccaggccagtcgccgcagctcctagccagcaggtcttccgagtccggttaccnggagtcgtacgagacgtaggttcaaggttacggaacacgggatacgagaaccactattctttacactactagaaactcgacgtccgtgtcggccgcgtgaggtacgttggtttgggggtttagtttattacgtcgtacgtagtcggactaacggtccgtaggttaaccggtaacccgggttaccgttaaccccgggtttcgggggacccgggggtaaccgttacggggtacgtaggggttaacggttacgttaaacgtcgggtaacgttggtcggtacgttacggtccttaaccgttaacg

SEQ ID NO: 303784 - DNA, 556 bp, Homo sapiens
  misc_feature: GZ8MTXP01A5NZJ.45.5.A05.1.454.CMB.2.raw
  modified_base (361)..(361): a, c, t, g, unknown or other
  misc_feature (361)..(361): n is a, c, g, or t
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtcctgaggctctcctgttaggtctggattcgtcttcagcgactacacctgagttcgggtccggctggctccgaggggaagagtctggagtggattgcgtacatcagtcattctgacttcgacgtntactcgcagctctggtgggagggccattcacctacgtttccgagggacgacgccgacgtaactcgtactttagctgcagntcggactagtctagacgacccgagacacggctatatattcngtcgcgtcgaggtagttaacgttcgggcgttccggtcggggcccgggaaccgtcggtccaccgtcgttccgccg

SEQ ID NO: 303785 - DNA, 561 bp, Homo sapiens
  misc_feature: GZ8MTXP01BB55K.45.5.A05.1.454.CMB.2.raw
  modified_base (316)..(316): a, c, t, g, unknown or other
  misc_feature (316)..(316): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtcctgaggctctcctgttaggttctggattcgtcttcagcgactactacctgagttgggtccgctggctccgagggaagngtctggagtggattgcgtacatcagtcattctgacttcgacgtctactacgcagctctggtgggacggggcctagttccaacctatttccgagggtacgaccgccgcgaactctactttatctgcagactggactagtctagacgacccgaagacacggccaatatacttactgtgcgcgaggtagttaacgttgggcgttcgtcgggggccccggtaaccgtcggtccaccgtcgttcccgccg

SEQ ID NO: 303786 - DNA, 583 bp, Homo sapiens
  misc_feature: GZ8MTXP01A0LQ3.45.5.A05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggattttagtacggacattgcggtgacccagactccactctccctgtccgtcacccctggcagtcggccnccatctcctgcacgtctagtcggancctnttacatacaaatggaaagtcttattgactggacctgcagagccaggccagtcgccgnagctcctagtccagcaggcttccgagtccggttccnggagtcgtcagacagggttcaagtggaacacgggatcgagacactatcttcatactagaaactcgagtccgtgtcgggccgcgtgaggtattggtttaggggttgttttaagttacctggtactaagtgacaaggtctaggtaacggtaccggtacgtaaccggtttcgggacccgggggtacaggggtccgttagggacgggttccgaaacgttccgggaaacgttgggttacggggccttacgggaaccaacccggttaag

SEQ ID NO: 303787 - DNA, 636 bp, Homo sapiens
  misc_feature: GZ8MTXP01AT22A.45.5.A05.1.454.CMB.2.raw
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
  modified_base (549)..(549): a, c, t, g, unknown or other
  misc_feature (549)..(549): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggtttccttgctattattataaaggtgtcctgtgtcaggtacagatggcggagtcgtgggggaagaacggtcaacccgtggcggtcctgagctctcttgttagtctggtattcgtcttcngcgactacacctggtaggttcgggtccgcgtggcctaccgaggggaagngtcgtgggaggtggattggcgtacntcagttcattctgtacttccgaccgttctaacgtcgacaagtctcgtgggtcgggacgggccgtattcccaaccttactttacccgaacggggaccgaccggcccggacgtaaacccttctaacctttagtaccttgacgtagtaagtcggtaacttaggtcgtaggaaccgaccccgaagaccgaacgcctaatatacttacngtgcggtcgaaggttacgttaacgttcggccggttcccggtcgggggccccgtaacccgtgggtcccttaccggtccttcccggccg

SEQ ID NO: 303788 - DNA, 566 bp, Homo sapiens
  misc_feature: GZ8MTXP01AF560.45.5.A05.1.454.CMB.2.raw
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtcaaccctggcgggtccctgagctctcctgttagtctggattcgtcttcagcgactacacctggaggttcgggtccggctgggcctaccgaggggaagaggtctgggagtggattggcgtacatcagttcattctgtacttccgacgtctactacgcagctctgggtgggacgggcctattccacctacttccgagggacgacgccgacgaactctactttatctgcagatggactagtctagacgaccgacgacgacgctatatactactgtgcgcgagtacgttaacgttcggcgttccggtcggggcccgggtaaccgtcggtccaccgtcgttccgccg

SEQ ID NO: 303789 - DNA, 684 bp, Homo sapiens
  misc_feature: GZ8MTXP01EKDZL.45.5.A05.1.454.CMB.2.raw
  modified_base (313)..(313): a, c, t, g, unknown or other
  misc_feature (313)..(313): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggtttcctgctattattataaaggtgtctgtgtcaggtacagatggcggagtcgtgggggaagaacggtcaaccgtggcggtcctgaggctctcctgtttagttctggtattcgtcttcagcgactactactggagttgggccgcgtggctccgagggaagngtcgtggagtggattggcgtacatcagtcattctgtacttcgacgtctactacgacagtctctgggtgggacgggcctattccaacctagttccgagggacgaccgccgacgtaaccttcgtactttacgtcgtacgctaaggtattcgggaacttaggtcctacgggaaaccgaaaccccggaaaggaacccgaaccgggtccctaaagtttaacttaacgtttaaccgtgggttacgaccgggtaacgggttaagggttaaacggtttaaaccggttcggggttcccggttcccgggtaaccggggggtacccccgggtaaacccggttcggggtaccccgaacccggttcccgttaaccccggcccgg

SEQ ID NO: 303790 - DNA, 516 bp, Homo sapiens
  misc_feature: GZ8MTXP01AS3Y2.45.5.A05.1.454.CMB.2.raw
  modified_base (139)..(139): a, c, t, g, unknown or other
  misc_feature (139)..(139): n is a, c, g, or t
  modified_base (186)..(186): a, c, t, g, unknown or other
  misc_feature (186)..(186): n is a, c, g, or t
  modified_base (228)..(228): a, c, t, g, unknown or other
  misc_feature (228)..(228): n is a, c, g, or t
  modified_base (455)..(455): a, c, t, g, unknown or other
  misc_feature (455)..(455): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccnccatctcctgcacgtctagtcggagcctcttacatacaaatggaaanacttatttgactggtacctgcagaggccaggccagtcgccgnagctcctagtccagcaggcttccagccggttccctggagtgtcagacaggttcagtggacacggatcagacacatctttcactctagaaatcagccgtgtggccgctggaggtatgttggtgtttaattactgcatgacaagctaggtacgaccgtactacgttgggccggggtaccagggcgtgggacggtcaacgttcgaacgtgtgcgtgcacatctgtccttnactcttcccgctatctgacttcgattcgctcgttgcggcgggctggcagggccataagngn

SEQ ID NO: 303791 - DNA, 692 bp, Homo sapiens
  misc_feature: GZ8MTXP01EE0F8.45.5.A05.1.454.CMB.2.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (321)..(321): a, c, t, g, unknown or other
  misc_feature (321)..(321): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcacccctgggcagtcggccgccatctcctgcacgtctagtcggancctntacatacaaatggaaatcttattgactggacctgcagagccagccagtcgccgcagctcctagtccagcacggcttccgagtcccggttccgnggactcggtaccaagtacgtagggttaccaaaggttacgggaaccaacgggaacttacgaaacggaacctactaacttttaccttttacctaacttaccttaaggaaaaaacttccaacgggtaccccggttagggttcgggacccgcgttagggtagggttaagtttagggtttgggggtttaaggtttttaactttaaccgtttgggacctaaagttcggaacgtaaacggttcgtaacgggttaaccggtacccgggttaaccggtaacccggtttcgggggacccgggggtacttacggggtaccgtagggttacggttaccgaaagtcggaacgttggtcggcgttacggaacttaaccgttaacc

SEQ ID NO: 303792 - DNA, 538 bp, Homo sapiens
  misc_feature: GZ8MTXP01AU97V.45.5.A05.1.454.CMB.2.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (475)..(475): a, c, t, g, unknown or other
  misc_feature (475)..(475): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaacccgtggcggtccctgaggctctcctgttagttctggattcgtcttcagcgactacacctgagttgggccgctggctccgagggaangtctggagtggattggcgtantcgagtcattctgacttcgacgtctactacgcagctctggtgggacggccgattcacctattccgagggacgacgccgacgaacgtctacttatcgtgcagatggactagtctagacgaccgaagacacggctatatatangtgcgcgagtagtacgttggcgttcgcggggcccgtaaccgtcggtccaccgtcgttccgccg

SEQ ID NO: 303793 - DNA, 572 bp, Homo sapiens
  misc_feature: GZ8MTXP01AX4IL.45.5.A05.1.454.CMB.2.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (433)..(433): a, c, t, g, unknown or other
  misc_feature (433)..(433): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaacccgtggcggtccctgaggctctcctgtttaggtctggtattcgtcttcagcgactactacctgagttgggccgntggctcgagggaangtctggagtggattggcgtacatcagtcattctgacttcgacgtctactacgcagctctggtgggagggtccgattcacctatttccgagggacgaccgccgcgaacctctactttancttgcagatcggactagtctagaacgacccgaagaccgacggcctatactattactgtcggcgtacgaggtacgttaacgttcgggccgttaccgggtcgggggtcccgggaaccgtcggtccgaccgtcgttccgccg

SEQ ID NO: 303794 - DNA, 558 bp, Homo sapiens
  misc_feature: GZ8MTXP01BPCI3.45.5.A05.1.454.CMB.2.raw
  modified_base (342)..(342): a, c, t, g, unknown or other
  misc_feature (342)..(342): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttccttgctattattataaaaggtgtcctgtgtcaggtacagatggcggagtcgtgggggaagaacggtcaacccgtggcgggtccctgaggctctcctgttaggttctggattcgtcttcagcgactactacctgagttgggtccggctggcctccgaggggaagagtcgtggagtggattgcgtacntcagtcattctgacttcgacgtctactcgacagctcgtggtgggacgggcctattcaacctatttccgagggtacgacgccgacgtaactctactttanctgcagntgtactagtctagacgacccgaagacacggcctaatatactcngtgcgcgaggtacgttaacgttcggcgttccgtcggggccccggaacgtcggcaccgtcttccgccg

SEQ ID NO: 303795 - DNA, 685 bp, Homo sapiens
  misc_feature: GZ8MTXP01C7L87.45.5.A05.1.454.CMB.2.raw
  modified_base (179)..(179): a, c, t, g, unknown or other
  misc_feature (179)..(179): n is a, c, g, or t
tcagacgcgatcgacacgaccggtgctcgatttagatagatagacaggggagctctgggagaagagccccagccccagaattcccaggagtttccactcggtgatcagcactgaacacacaggactcaccatggagtttgggctgagcttgggttttccttgctattattataaaggtntcctgtgtcaggtacagatggcggagtcgtgggggaagaacggtcaacccgtggccggtccctgacggctctccttgtttaggtctggtattcgtcttcagccgactactaccgtggtaggttcggggtcccggcgtggccgtaccgaaggggaaagaggtcgtggggagtggtattggcgtacatccgagtctattctgtacttccgaccgttctaactacgcagtctcgtggtgggacggcccgtattaccacctacttccgagggaccgacgcccgacgaactctaactttactctagcgaagtactacggtaacgttacggtccgtacggaaaccggaaccccggaaacggacccgaaccggtaccctaaattaacttacgttactggttcgcgggtacggagggttaacggttaacgttcggggttccggttaccccggggtccgggggtacccccgggtaacccgtcgggtcccgacccggttcccgttccgtaaccccg

SEQ ID NO: 303796 - DNA, 602 bp, Homo sapiens
  misc_feature: GZ8MTXP01A7ZTB.45.5.A05.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctggcagtcggccgccatctcctgcacgtctagtcggancctcttacatacaaatggaaatactttattgtactggtacctgcagaggccaggccagtcgccncagctctagtccagcagcttccagccgttccnggagtcgtcagacaggttccaagtcggaacacgggatcagacacaacttctttacacttactagaaaactcgagtccgtgtcggccgcgttgaagggtagttggtttacgggggtttgttttaacttacgtcggtactaagttcgacgtaaacggtcgttggtaaccggtaacccggggttaaccgtaaccggggttttcggggaccccggggggtaccgaagggtccggtagggacggttcgttaacgtcggaacgtggtgtcgttacgtccaacgttcg

SEQ ID NO: 303797 - DNA, 662 bp, Homo sapiens
  misc_feature: GZ8MTXP01AI3L3.45.5.A05.1.454.CMB.2.raw
  modified_base (227)..(227): a, c, t, g, unknown or other
  misc_feature (227)..(227): n is a, c, g, or t
  modified_base (646)..(646): a, c, t, g, unknown or other
  misc_feature (646)..(646): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacagacattgcggtgacccagactccactcctccctgtcccgtccaccccgtggcagtccggccgccatctcctgcacgtctagtcggancctacttacataacaaataggaaatacttattgtactggtacctgacagacggccaggcccaggtccgccgcacgcctcctagccaggcacggtccttccgacggtcccggttccctggggtacgtcgtcgaagtacgtaggttacaggtcggaaacgtacgggatacgaacgtacaacttacttcctttacacttacgtaacggtaaaactccgtacggtccgtcggttcgggcccgtacgttaggtagggttagtttggggtttgggtttacgttttaaattccgtagtcgtagttacggacgtaacggtccgttacgggtaaccggtaccgggttaaccgttacccggggttcggggacccgggggttacgacgggtcggttaggggttacgttacgtaacgtccggtaagtcggngttcgtcgcgtaaccg

SEQ ID NO: 303798 - DNA, 649 bp, Homo sapiens
  misc_feature: GZ8MTXP01EMZA7.45.5.A05.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (330)..(330): a, c, t, g, unknown or other
  misc_feature (330)..(330): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcaccccgtgggcaggtccggccgccatctcctgcacgtctagtcgancctctacatacaaatggaaatacttattgtactggaccngcagaggccaggccagtcgccgcacgtctcctagtccagcacgggtcttccgagtcccggttccnggacgtcgtcaaggtacgaggttcaaagggtcggaacacgggataccgaacgtaacctactatttcctttaccaacttactaagtaaaactccgaacggtcccggtggtcggtccgtacgtaggtaagggttagtttgggtttagggggtttagttttagttaaccgttggtactaagtcgtacgtaaacggtcgtacgggttaaccgtacccgggttaacgtaacccgggtttcggggacccgggggaaccgttagggccgttagggacggttacgttaaacgtcggtacgtgggttcgacgttcgccttaacgttcg

SEQ ID NO: 303799 - DNA, 568 bp, Homo sapiens
  misc_feature: GZ8MTXP01EYC3K.45.5.A05.1.454.CMB.2.raw
  modified_base (223)..(223): a, c, t, g, unknown or other
  misc_feature (223)..(223): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtacttattgtactggtacctgcagaggccaggccagtcgccgcagctcctagtccagcagggcttccgacgtcccggtttccctgggacgtcgtaccacacgtagggtttccaaagggttcgggaaccacgggataccgaagacctactattcctttcactctagaaaatcaagtcccggtgtcggccgcgtgaggtattggttggggttgttttattactgcatgacaagtctagtacgtaccggtacgtccggttcgggccgggggtacaggcgtagggacggttcaacgtcggacgtggtcggcttcgcttaacgtaacg

SEQ ID NO: 303800 - DNA, 576 bp, Homo sapiens
  misc_feature: GZ8MTXP01EQN1R.45.5.A05.1.454.CMB.2.raw
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccctggcggtcctgaggctctctgttaggtctggattcgtcttcagcgactactacctgagttgggtccgctggctccgagggagagtctggagtggattgcgtacatcagtcattctgacttcgaccgtctacacgcagcttcgtggtcgggagggccctattcaccctatttccgaagggtacgacggccgacgtaacctctactttatctgcagatcggactagtctaggacgacccgaagacgacggcctatatattctgtgcgcgaggtagttaacgttggttccgttccggtcgggggtaccccggaacccgttcgggtccgacccggtccgttcccggtcccg

SEQ ID NO: 303801 - DNA, 648 bp, Homo sapiens
  misc_feature: GZ8MTXP01DGAAV.45.5.A05.1.454.CMB.2.raw
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtagggggaagaacggtccaacccgtggcgggtccctgaggctctcctgtttaggttctggtattcgtcttcagcgtactactaccgtggaggttgggtcccggctggccttccgaggggaaagaggtctgggagtggattggcgtacatcctagtctagttctgtaccttccggaccgttctactcgacagctcgtggtcgggacgggcctattcaccctactttccgagggtacgacgccgacgaacgtctactttancgtncagntgggactagtctacggacgaacccgagaccgaacgcctaatacgtacttcgtaagtgccggtacggacggttacgttaacgttcggggttcccggttccgggtcccggggggaccccgggtaaccccgttcggggtaccccgttacccggttcccgttcccggaaccccgg

SEQ ID NO: 303802 - DNA, 615 bp, Homo sapiens
  misc_feature: GZ8MTXP01CZ4KO.45.5.A05.1.454.CMB.2.raw
  modified_base (223)..(223): a, c, t, g, unknown or other
  misc_feature (223)..(223): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
tcagacgcgatcgacacgaccggtgctcgatttagatagatagacagggtgctgctgaggctgtaggtgctgtccttgctgtcctgctctatgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtacttattgtactggtacctgcagaggccaggccagtcgccgcagctcctagtccagcaggcctccgagtcccggttccnggacgtcgtcaggacaggttcaaggtggaacacgggatacagacactattcttcactntagaaatcgagcgtgtcggccgcgtagaggtagttgggtttggggttagttttagttacgtggtactaagtcgacgtaaaggtcgttacggtaacggtaacccgggttaccgtaaccccgggtttcgggggacccggggggtaaccgacggggtaccggttaggggttaacgggttacaaacggttcggtaaaccgttgggtcgggaccgttcgaaccgttaaccgttaacg

SEQ ID NO: 303803 - DNA, 634 bp, Homo sapiens
  misc_feature: GZ8MTXP01AM3S9.45.5.A05.1.454.CMB.2.raw
  modified_base (342)..(342): a, c, t, g, unknown or other
  misc_feature (342)..(342): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtccaacccgtgggcggtccctgaggctctccttgtttaggttctggtatttcgtcttcagccgtacttactacccgtggtaggttcggggtcccggcgtcgggcctaccgaggggaagnggtcgtgggagtggattgcgtacagtcagttctattctgtacttccgaccgttctactcgaacagtcctgtggtagggacgggccgtattccgaaccctagtttcccgagggaccgacgcccgacgtaacctcctactttatcctgctagtatggtactagtctagaacgacccgaagaccgaccggacctagtactactcgtgtcgacggtcggaggtacgttaacgttcgggccgttccgggtccgggggcccgggtaacccgtcggtcccgttacctccgttccgcccg

SEQ ID NO: 303804 - DNA, 573 bp, Homo sapiens
  misc_feature: GZ8MTXP01BK8P8.45.5.A05.1.454.CMB.2.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
  modified_base (457)..(457): a, c, t, g, unknown or other
  misc_feature (457)..(457): n is a, c, g, or t
  modified_base (511)..(511): a, c, t, g, unknown or other
  misc_feature (511)..(511): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtcaacccgtggcggtcctgaggctctcctgtttagtctggattcgtcttcagcgactactacctgagttgggccgctggctccgagggaagngtcgtggagtggattgcgtacatcagtcattcngtacttccgacgtctactacgcagctcgtggtgggacgggcccgtattccgaaccctacgtttccgaacggggtaccgaccggcccgacggaaaccttctaactttacncttgacagactggacttagtctagacgacccgaagacacggcctatatattacngtgcgcgagtagttacgttggcgttccggtcggggccggaaccgtggcaccgtcgttccgcg

SEQ ID NO: 303805 - DNA, 601 bp, Homo sapiens
  misc_feature: GZ8MTXP01A0P2W.45.5.A05.1.454.CMB.2.raw
  modified_base (216)..(216): a, c, t, g, unknown or other
  misc_feature (216)..(216): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttccttgctattattataaaaggtgtcctgtgtcaggtacagatggcggagtcgtgggggaanaacggtcaacctggcggtcctgagctctctgttagtctggattcgtcttcagcgactactacctggtagttgggtccggctggcctccgagggaagagtcgtgggagtggattgcgtacntcagtctattcngtacttcgacgtntactacgcagctctgnggacggcctatcactattccgagggtacacgccgacgaactctacttacnctgcagatagggactagctacgaacgtacccgagaccacggcctaagtactacgttacgtgtcgcggtacggttacggtaaacgggtttacttcggggttccggttcccgggttccggggggtaccccggtaacccgttcgggtacccgacccggtcccgttcccggtaacccg

SEQ ID NO: 303806 - DNA, 641 bp, Homo sapiens
  misc_feature: GZ8MTXP01AXRA7.45.5.A05.1.454.CMB.2.raw
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccgtggccggtccctgaggctctcctgtttaggttctggtattcgtcttcagcgactacacctgagttgggtccgntggcctcgagggagngtcgtgggagtggattggacgtacatcgagttcattctgacttcgaccgtctactacgacagtctgtgggngggacggggcctattcacctattccgagggacgacgccgcgaactctacttatctcgcagatggactagtctagaaccgacccgaagaccgtacggacctagttaactactttaaccgtggtcggacggtacggttaacgggtaggtttaaccggttcggggttcccgggttcccggttccgggggggtacccccgggtaaccccgggttcggggtaccccggttaccccgggttcccgttccccgggtcccg

SEQ ID NO: 303807 - DNA, 614 bp, Homo sapiens
  misc_feature: GZ8MTXP01DSCIQ.45.5.A05.1.454.CMB.2.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (598)..(598): a, c, t, g, unknown or other
  misc_feature (598)..(598): n is a, c, g, or t
  modified_base (606)..(606): a, c, t, g, unknown or other
  misc_feature (606)..(606): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtcccgtcaccccgtggcacgtcggccgccatcctcctgcacgtctagtcggancctcttaacataacaaataggaaagtctttattgtactggtacctgcagacggccaggccagtccgccnacgtcctcctagccagcacggtcttccgacggttcccggttccgtggacgtcgacgaagacgtagggttcaaaggtcggaacgtacgggatacgaacgtacactactttcttacacttactaagaaactcgacgtccgtgtcggcgacgtagtaggttgtttgggttaggggtttacgttttagttaccgtggtactgtgaacgtaagtcgtaggtaccgtaccggtaaccggtcggtttacggggaccgggggaccttaggtcggtaggttacgttacaacggtcgacgtggtcggtcncgtaaccncgttaacg

SEQ ID NO: 303808 - DNA, 587 bp, Homo sapiens
  misc_feature: GZ8MTXP01AH6G8.45.5.A05.1.454.CMB.2.raw
  modified_base (356)..(356): a, c, t, g, unknown or other
  misc_feature (356)..(356): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtcaacccgtggcggtcctgaggctctcctgttagttctggattcgtcttcagcgactactacctggacgttgggtccggctgggctccgagggaagagtcgtgggagtggattgacgtacatcagtcattcngtacttcgacgtctactcgcagctctgggtgggacgggcctattccactactttccgacggggaccgaccggcccgacgtaacctctaactttatcgtcgcagtatggactagtcacggacgacccgagaccacggacctagtactagttacnggtacgcggtacgnggtagttacgttcggccgttccggcgggggcccggtaaccgtcgggtccaccgtcgttccgccg

SEQ ID NO: 303809 - DNA, 522 bp, Homo sapiens
  misc_feature: GZ8MTXP01AZMLW.45.5.A05.1.454.CMB.2.raw
  modified_base (222)..(222): a, c, t, g, unknown or other
  misc_feature (222)..(222): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcaccctggcagtcgccgcatctcctgcacgtctagtcggancctcttacatacaaatggaaatcttattgtactggtacctgcagaggccaggccagtcgccgcagctcctagtccagcaggcttccgagtcccgttccnggagtcgtcagacngggttcaagtcggaacacggatcgagactacattcttacactctagaaatcgagtcgtgtcgcgcgtgaggtagttgttggggttnttttaagtctgctagtcgagaagtcgtagtacgtaccgtacgtaaccggttcgggccgggacgagcgtggcgttcagtcgtatggtcgtncgcgttaactg

SEQ ID NO: 303810 - DNA, 560 bp, Homo sapiens
  misc_feature: GZ8MTXP01D5XKF.45.5.A05.1.454.CMB.2.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (401)..(401): a, c, t, g, unknown or other
  misc_feature (401)..(401): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcgccncatctcctgcacgtctagtcggatcctnttacatacaaatgaaatcttattgactggactgcagagccaggccagtcncgcagctcctagtccagcaggccttccgagtccggttccnggactcgtcagacngggttcaaggtcggaacacgggataccagactactattccttcactactagaaatcgagtccgtgtcggccgngtgaggtattggtttagggttagttttattactgctagtgtcaaagtcgtagtacggtaccggtacgtaaccggtttcgggccggggtaccgagggtcgttgggacgggttcttaaacgtcgtaaacgtggttcgggcttggccgttaacccgttaacg

SEQ ID NO: 303811 - DNA, 581 bp, Homo sapiens
  misc_feature: GZ8MTXP01B6GC4.45.5.A05.1.454.CMB.2.raw
  modified_base (317)..(317): a, c, t, g, unknown or other
  misc_feature (317)..(317): n is a, c, g, or t
  modified_base (526)..(526): a, c, t, g, unknown or other
  misc_feature (526)..(526): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtcctgaggctctcctgtttagtctggattcgtcttcagcgactactacctggagttcgggtccgctggctccgagggagngtctggagtggattgcgtacatcagtcattctgtacttcgacgtctactacgcagctcgtgtgggacgggtccgtattcccgaacctagtttcccgaaggggtaccgaccggcccggaccgaaaccttccgtacttttactcttgcaagtactaggggacttagtcctaggacgaacccgaagacgacggcctatactatactgtgcgngaggtattacgttggcgttcgtcggggcccggaaccgtggtcaccgtcgttccgc

SEQ ID NO: 303812 - DNA, 593 bp, Homo sapiens
  misc_feature: GZ8MTXP01BT8Y9.45.5.A05.1.454.CMB.2.raw
  modified_base (313)..(313): a, c, t, g, unknown or other
  misc_feature (313)..(313): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtccctgaggctctctgttagtctggattcgtcttcagcgactactacctgagttgggccgcgtggctccgagggaanagtcgtggagtggattgacgtacatcgagtctattctgtacttccgacgtctactacgacagtctcgtggtgggacggcctatcactacttccgagggacgacgccgacgtactctacttatctgacagtatggactagtcgtagaacgacccgaacgacgaccggacctagtactatcgtgtcgccggtaggaggtacgttaacgttcgggttccgttccgggtccgggggaccccggtaacccgtcgggtccgttacccggtaaccgttcccgaaccg

SEQ ID NO: 303813 - DNA, 672 bp, Homo sapiens
  misc_feature: GZ8MTXP01C4ONK.45.5.A05.1.454.CMB.2.raw
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatcctggatttagtacggacattgcggtgacccagactccactctcctgtccgtccaccctggcagtcggccgccatctcctgcacgtctagtcggancctcttaacataacaaagtaggaaaagtactttattgtactggtactgcagacgcagccagtcgccgcngcctcctagtccagcacggtcctccgacggtcccgttaccgnggtacgtcgtccgagtaccgtaggttccaaagggtcggaacgacgggtaataccgaacgactactaactttcctttacaacttaactaaggtaaaactccgtaaacgggtcccggttggtacgggcccgtacgtagggtaagggttagtttgggtttacggggtttaggtttttaaacttaaccgtggtaacctaagttcgaaccgtaaaggtcgttaacgggtaaccgtacccgggttaaaccgtccgggtttacgggggacccggggtacgagggtcgtagggacgttcgttaaacgtcgaacggtttggacggtcttacgaacccttcgttaacg

SEQ ID NO: 303814 - DNA, 664 bp, Homo sapiens
  misc_feature: GZ8MTXP01C5O1C.45.5.A05.1.454.CMB.2.raw
  modified_base (245)..(245): a, c, t, g, unknown or other
  misc_feature (245)..(245): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtccaacccgtgggccggtcccngaggctctcctgtttaggtctggtattcgtcttcagcgtactactacctggaggttgggtccggctgggcctccgaggggaagagtcgtgggagtggtattggcgtacatcagttcattcngtacttccgacgtntactacgcagctntggtgggacggccgtattccacctactttccgagggaccgacgccgaccgaactctactttatcgtgacagatggtaactaggtctacgaacgaacccggaagaccgaaccggaccctaagtaacttacgttacgtggtcggacgggtacggaacgggttaacggtttaacggttcggggttcccggttcccggggttcccggggggtacccccgggtaaccccgggttcgggtacccggttacccggttcccgttaacccggaaccccgg

SEQ ID NO: 303815 - DNA, 632 bp, Homo sapiens
  misc_feature: GZ8MTXP01C2YJ6.45.5.A05.1.454.CMB.2.raw
  modified_base (319)..(319): a, c, t, g, unknown or other
  misc_feature (319)..(319): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtcctgaggctctcctgtttaggtctggtattcgtcttcagcgactactacctggaggttgggccggctggctccgagggaagngtctgggagtggatgcgtacatcagtcattctgtacttccgacgtctaccgtacgccagccttttcggggttagggacgggccatttccacctactttccgagggaccgaccgccgacgaacttctactttanctgcagntaggacttagtctagacgaaccccgaagaccgtaaccggcctaagtactactttaccgtggtcggccggtacggagggtaacggtttaacgttcggggttccgttcccgggtccggggggtacccccggtaaccggtcgggtacccgaccccgttccgttccccggtaacccg

SEQ ID NO: 303816 - DNA, 524 bp, Homo sapiens
  misc_feature: GZ8MTXP01BHPFV.45.5.A05.1.454.CMB.2.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (392)..(392): a, c, t, g, unknown or other
  misc_feature (392)..(392): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtcccgtcacccctgggcagtcggccgccatctcctgcacgtctagtcggancctnttacatacaaatggaaagacttattgtactggactgcagagccaggccagtcgcgcagctccagtccagcaggcttccagccggttccctggatcgtcagacaggttcaagtggcacggatcagacacatctttcactctagaaatcagccgtgtggccgntgagatgttgggtgtttatactgcatgcaagctgtagtacggtacgtaacgttcgggttccggggaccggacggcgtgggaggttcgttaacgtaacgtacgtaacggtgggcgttcggtcgaaccgtaacg

SEQ ID NO: 303817 - DNA, 523 bp, Homo sapiens
  misc_feature: GZ8MTXP01D8A3Z.45.5.A05.1.454.CMB.2.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcacccctgggcagtcggccgccatctcctgcacgtctagtcggancctcttacatacaaatggaaagtcttatttgactggacctgcagagccaggccagtcgcncagctcctagtccagcaggcttccagccggttccnggatcgtcagacaggttcaagtggaacacggatacagacactattctttcactctagaaaatcagccgtgtgcgctgagtatgttggggttgtttattactgcatgtcgaagctgtacgtaccggtacgtaaccgttcggttccggggaccggacggcgtggaggttcgaagtaacgtaacgtgtggtcgttcgtcgcgtaacg

SEQ ID NO: 303818 - DNA, 574 bp, Homo sapiens
  misc_feature: GZ8MTXP01CEFAL.45.5.A05.1.454.CMB.2.raw
  modified_base (217)..(217): a, c, t, g, unknown or other
  misc_feature (217)..(217): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaaccgtggcgggtcctgaggctctcctgttagtctggtattcgtcttcagcgactacacctgagttgggtccgntggctcagggaangtctggagtggattgcgtacatcagtcattcngtacttcgacgtctactacgcagctctggtacgggagggccctagttccacctacgtttccgagggacgaccgaccgacgaaccttcactttacncttgcagatcgggactaagtctagaacgacccgaagacacggacctagtatatactggtgcggacgaggtaacgttcgttacggttccgttccggtcggggacccggtaacccgtggtccaccgtccgttccgccg

SEQ ID NO: 303819 - DNA, 579 bp, Homo sapiens
  misc_feature: GZ8MTXP01C5XC3.45.5.A05.1.454.CMB.2.raw
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtggggggaagaacggtcaacccgtggcgggtcctgaggctctctgtttaggtctggattcgtcttcagcgtactactacctggaggttgggtccgctggcctcgagggaagagtctgggagtggatgcgtacatcagtcattctgacttcgacgtntactcgacagctntgngggacggccgattcactattcgagggacgacgccgacgaactctactttactctgcagatggaactagtactagacgaacccgaagacgaacggcctaatataattctgtcgcgacggaggtagttaacgttcgggttccgttcccggtcgggggccccgggtaacccgtcgggtccgacccgtccgttcccgaacccg

SEQ ID NO: 303820 - DNA, 591 bp, Homo sapiens
  misc_feature: GZ8MTXP01A1GJW.45.5.A05.1.454.CMB.2.raw
  modified_base (326)..(326): a, c, t, g, unknown or other
  misc_feature (326)..(326): n is a, c, g, or t
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
  modified_base (500)..(500): a, c, t, g, unknown or other
  misc_feature (500)..(500): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtcaaccgtggccgggtccctggacggctctccttggtttaggttctggtattcgtcttcagcgactactaccgtgaggttgggccgctggcctcgagggaagngtcgtggagtggattgacgtacatcgagtcattctgtacttcgacgtctactcgcagtctgtgngggacggcctatctacctattccgaggacgacgccgacgaacctcgtacttntctgcagatcgactacgtctacgaacgacccgagaccgacgctatatattactgtcgngtacggttaggtacgttaacgttcgggaccgttccgggtccgggggtacccggtaaccgtcggtaccgttaccgtcccgttccgtaacccg

SEQ ID NO: 303821 - DNA, 570 bp, Homo sapiens
  misc_feature: GZ8MTXP01DJ21S.45.5.A05.1.454.CMB.2.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaacccgtggccggtcctgaggctctcctgtttaggtctggattcgcttcagcgactactacctgagttgggccgctggctcgagggaacgngtctggagtggattgcgtacatcagtcattcngtacttcgacgtntactcgacagctcgnggtgggacgggtcccgatttcacccatttccgagggtacgacgcgacgaaactctaactttacnctgcaagactggtactagtctgacgacccgaagacacggcctattatacttagtgtgcgtcggaaggtacgtacgttcgggcgttccggtgggggtcccggaacccgttggccttccgtaacgttcccgcg

SEQ ID NO: 303822 - DNA, 569 bp, Homo sapiens
  misc_feature: GZ8MTXP01B8H1D.45.5.A05.1.454.CMB.2.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaacccgtggcgggtccctgaggctctcctgtttaggtctggattcgtcttcagcgactactacctgagttgggtccgctggctccagggangtctggagtggattgcgtacntcagtcattctgacttcgacgtctactacgcagctctgggtgggacgggcccgatttccacctactttccgagggtacgacgcccgacgaacctctactttatcttgctagatggactagtctgacgacccgaagacgacggccatatacttctgtgcgcgaggtacgttacgttcggttcgttcccggtcgggggccccggtaacccgtcgggtcgaccgtccgccgtcccg

SEQ ID NO: 303823 - DNA, 584 bp, Homo sapiens
  misc_feature: GZ8MTXP01BSTWT.45.5.A05.1.454.CMB.2.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (388)..(388): a, c, t, g, unknown or other
  misc_feature (388)..(388): n is a, c, g, or t
  modified_base (443)..(443): a, c, t, g, unknown or other
  misc_feature (443)..(443): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattaataaaaggtgtcctgtgtcaggtacagatggcggagtcgtagggggaagaacggtcaaccgtggcggtccctgaggctctccttgttaggttctggtattcgtcttcagcgactactacctggacgttgggccgntggctccgagggaangtctggagtggatgcgtacatcagtcattctgtacttccgacgtctactacgacaagtctcgtggngggacgggcctattcacctattccgagggtacgacgccgacgtaactctacttanctgcagtatcggaacttagtctagacgaacccgaagaccgacgacctatactacttacgtgtgcgacggaggtaacgttacgttcgggttccgttcggtcgggggccccggtaaccttcgggtccaccgtccgttccgccg

SEQ ID NO: 303824 - DNA, 774 bp, Homo sapiens
  misc_feature: GZ8MTXP01CPFO6.45.5.A05.1.454.CMB.2.raw
  modified_base (219)..(219): a, c, t, g, unknown or other
  misc_feature (219)..(219): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttcctgctattattataaaaggtgtcctgtgtcaggtacagatggcggagtcgtggggggaanaacggtcaacccgtggccgggtccctgaggctctctgttagtctggtattcgtcttcagcgtactactaccgtggtaggttcgggtccggctgggcctccgaggggtaagngtcgtgggagtggatttcggacgtacatcgagtcattctgtacttccgacgtntactacgctagctcgtggtcgggacgggcctattcccgaacctacgtttacccgaacgggtaccggtaccggacccggaccggtaaaccgttaccttaaccgttttacgtaccgttacgaccgtaagtaacgttacgggtaacgttaacggttaccgtacgggtaacccggaaccccggaaacggaacccgaaccggggtaccctaaagttaacctaagtttacgttaacgggttcggaccgggtaccgggttaaacgggtaaacggttttaaccgggttcggggttcccggggttaccccggggttcccgggggggtacccccggggttaaccccggttaccgggggttaccccgttaccccggggttcccgttccccgggtaaccccgg

SEQ ID NO: 303825 - DNA, 655 bp, Homo sapiens
  misc_feature: GZ8MTXP01E1OIN.45.5.A05.1.454.CMB.2.raw
  modified_base (496)..(496): a, c, t, g, unknown or other
  misc_feature (496)..(496): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaacaacggtcaacccgtgggccgggtccctggacggtctctccgttgtttaggttctgggtattcgtcttcagcgtactactaccgtggtacgttcgggtccgcgtaggcctccgaggggaagtaggtcgtgggtagtggatttgacgtacatcgagttcctattcctgtaccttccggaccgttctaacctcgaacagtcctcgtgggtagggacgggcccgtaattccaaccgttacttccgacgggaccgacgccgtacgaacctcgtactttactcncgacagtatcgggacttacggtctaggacgacccgaagaccgacggcctattacgtacttacgtggtcgcggacgttgggtaacgttacggttcggttccgttcccgggtcgggggaccccgttaacccgcggtccgaccccgtcgttcccggaacccg

SEQ ID NO: 303826 - DNA, 662 bp, Homo sapiens
  misc_feature: GZ8MTXP01C5YLX.45.5.A05.1.454.CMB.2.raw
  modified_base (229)..(229): a, c, t, g, unknown or other
  misc_feature (229)..(229): n is a, c, g, or t
  modified_base (335)..(335): a, c, t, g, unknown or other
  misc_feature (335)..(335): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagacctccactctccctgtccgtcacccgtgggcaggtcggccgccatcctcctgcacgtctagtcggancctcttacataacaaatggaaagtacttatttgtactggtacctgcagaggccaggccagtccgcgcagcctcctagtcagcagggtcttccgagtcccggttccngggacgtcgtacaggtacgtacggtcaaagggttcggaacacgggtatccgagacctactattcctttacacttactaagtaaacgtcaacggtccgttaggtcggtccgcgtaggagggtacgtttgggtttagggggtttagttttaacgtttacgtcgtacgtagttacgacgtaaacggtcgttagggtaaaccggtacccgggttaaccgtaaccgggtttccgggggaccgggggtaccggttacgggtacgggtagggggttaccgttaacggttaccggtaacgttgggttcggacgtcggacctaaccgttctttccg

SEQ ID NO: 303827 - DNA, 669 bp, Homo sapiens
  misc_feature: GZ8MTXP01EHPTF.45.5.A05.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (314)..(314): a, c, t, g, unknown or other
  misc_feature (314)..(314): n is a, c, g, or t
  modified_base (473)..(473): a, c, t, g, unknown or other
  misc_feature (473)..(473): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattaataaaaggtgtcctgtgtcaggtacagatggcggagtcgtgggggaanaacggtcaaccgtggccggtcccngaggctctctgtttagtctggattcgtctcagcgactacacctgagttgggccgctggctccgagggaagngtcgtggagtggattgcgtacatcgagttcatttcgtagtaccttccggaccgtctaacgtcccgaactacgtcttcgtgggtacgggacgggtacccgtatttccaacccgttacgtttaccgacgggtaccgacgccgacgtaactctacgtttacncgttgactagtactacggtacgttacgtcgtacggaacgacccgtaaaggaccgaaacggtccctaagttacgttactttaacgcggttcgacgggtacgttacgggtaacgtttaacggttcgggttccggttaccgggtccgggggaccccgggtaaccgtcgggtacccgttacccgtccgttcccgaacccg

SEQ ID NO: 303828 - DNA, 604 bp, Homo sapiens
  misc_feature: GZ8MTXP01E1P1M.45.5.A05.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagacgcgatcgacacgaccggtgctcgatttagatagatagacagggtgctgctgaggctgtaggtgctgtccttgctgtcctgctctgtgacactctccgtggggctgctaatgctctggatccctggatttagtacggacattgcggtgacccagactccactctccctgtcccgtcacccgtggcagtccggccnccatctcctgcacgtctagtcggancctcttacatacaaatggaaatcttattgtactggtacctgcaggaggcccaggccaggtccgccgcacgcctcctagtcccagccacgggtccttcccgacggtccccgggttccctggggacgtcgtccaggaccgtagggttcaagggtcggaaccacgggatcagacactattccttcactactagaaactcgacgccgtggtcgccgcgtggaggtagttggtttcggggtttagtttattacctgcagtgacgtaacggtcgtacggtaaccggtacccggttaaccgtaacccggtttcgggggacccgggggaccgagggcggttgggacggttccaacgtcggaacgtcggtggccttcgccaaccgtcg

SEQ ID NO: 303829 - DNA, 523 bp, Homo sapiens
  misc_feature: GZ8MTXP01A7JZR.45.5.A05.1.454.CMB.2.raw
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (421)..(422): a, c, t, g, unknown or other
  misc_feature (421)..(422): n is a, c, g, or t
  modified_base (466)..(466): a, c, t, g, unknown or other
  misc_feature (466)..(466): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtagggggaagaacggtcaacccgtggcgggtccctgagctctcctgtttaggttctggattcgtcttcagcgactacactgagttcggcgntggctcgagggaangtcnggagtggattgcgtacatcagtcattctgacttcgactntacagcagctctgtaggaggcattcacagttccaggggacacgccgtnaaactcaactttncgtnnagatagatagtacgtacgacgaccgacgacgacgactatatatntgtgcgcgagtagtacgttcgcgttcggtcgggccggaaccgcgtcgacgtcgcgcg

SEQ ID NO: 303830 - DNA, 787 bp, Homo sapiens
  misc_feature: GZ8MTXP01CLGS1.45.5.A05.1.454.CMB.2.raw
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtagggggaagaacggtcaacccgtggcgggtccctgacggctctcctgtttaggtctggtattcgtcttcagcgactacactgagttgggccgntggctccgaggagagtcgtggngttaggattcggacgtacatcgagtctattctagtactttccggaccgttctacgtacgaccagtcctgtgggtgggaacggggtccctattcccacccttacgtttacccggaacggggacccgtaccggacccgtaccggtaaaccttcccgttaaacttttacacccttagggaccaaggtaacgttaggggtaaaccctttaacgggttccgttaacggaaacccgggaacccccggtaaaacgaacccgaaacccggggtacccctaaaagtttaactttaaaccgtttacgttaacgggttacggaccggggtacggttaaacggggtttaaacggtttaaaccggtttcgggggttaccccggttcccgggttaacccggggggggtaccccccggtaaacccggttccgggggttccccgaaccccggtttcccgttccccggggtaaccccg

SEQ ID NO: 303831 - DNA, 499 bp, Homo sapiens
  misc_feature: GZ8MTXP02G9527.45.5.A05.1.454.CMB.2.raw
  modified_base (244)..(244): a, c, t, g, unknown or other
  misc_feature (244)..(244): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (460)..(460): a, c, t, g, unknown or other
  misc_feature (460)..(460): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcaccctgggcagtcggccgccatctcctgcacgtctagtcggagcctcttacatacaaatggaaanacttattgtactggtacctgcagaggccaggccagtcgccgnagctccagtccagcaggcttccagccgttcctggatgtcagacaggttcagtgacacggntcagacacatctttcactctagaaaatcagccgtgtcggcgctgaggtatggttgtgtttattactgcatgcaagctgtacgaccggtactacgttcgggcggggaccagggcncggaggtcaacgtcgaacgtgtcgctcgacacactctcg

SEQ ID NO: 303832 - DNA, 561 bp, Homo sapiens
  misc_feature: GZ8MTXP02IYR9B.45.5.A05.1.454.CMB.2.raw
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccctggcggtcctgaggctctctgttaggtctggattcgtcttcagcgactactacctgagttgggtccggctggctccgagggaagagtctggagtggattgcgtacagtcagtcattctgacttcgaccgtctactacgcagctctgtgggaggccgattcacctatttccaggacgacgccgcgaaactctactttatctgcagatgactagtcctgacgacccgaagacacggaccatatattactagtgacgcggaggtacgttaacgtcgggtccgttccggtcgggggccccgggaaccgttcggtcccgtaccggtccgtcccgccg

SEQ ID NO: 303833 - DNA, 508 bp, Homo sapiens
  misc_feature: GZ8MTXP02GB4TT.45.5.A05.1.454.CMB.2.raw
  modified_base (229)..(229): a, c, t, g, unknown or other
  misc_feature (229)..(229): n is a, c, g, or t
  modified_base (507)..(507): a, c, t, g, unknown or other
  misc_feature (507)..(507): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgnagctcctagtccagcaggcttccagccggtcctggatgtcagacaggttcagtggacacggatcagacacatctttcactctagaaaatcagccgtgtggccgctgagatgttggtgtttattactgcatgcaagctgtagaccgtactaccgtttgggccgggggacagggctgggagtcaagtcgaactgtggctggcaccatctgtcttcattccttcccgcatctgactcgactcgcgtctcggacgtcgggctcggacacgggcgacagtagng

SEQ ID NO: 303834 - DNA, 578 bp, Homo sapiens
  misc_feature: GZ8MTXP02JQY28.45.5.A05.1.454.CMB.2.raw
  modified_base (314)..(314): a, c, t, g, unknown or other
  misc_feature (314)..(314): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaacccgtggcgggtcctgaggctctcctgttaggtctggattcgtcttcagcgactactacctgagttgggtccgctggctccgagggaanagtctggagtggattgcgtacatcagtcattctgacttcgaccgtctactacgcagctctgtgggagggccattcacctattccgagggcgacgccgcgaactcactttanctgcagntgactagctaggaacgacccgaagacgacggcctaagtaactattacgtgtgcgacgtaggtacgttaacgttcgggccgtttacccggcgggggtcccccgggtaaaccgtcggggtacccaccccggtttccgtccccggaccg

SEQ ID NO: 303835 - DNA, 549 bp, Homo sapiens
  misc_feature: GZ8MTXP02F3332.45.5.A05.1.454.CMB.2.raw
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (541)..(541): a, c, t, g, unknown or other
  misc_feature (541)..(541): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaanaacggtcaacccgtggcggtcctgaggctctcctgttaggtctggattcgtcttcagcgactactacctgagttggtccgntggctcgagggaanagtctggagtggattgcgtacatcagtcattctgacttcgaccgtntactacgcagctcgtggtggacgggcctattcacctatttccgaggacgacgccgcgaactctacttatctgcagatgacttagtctagacgacccgaagacgacggacatactattactgtgcgcgaggtacgttacgtcggcgtaccgtcgggggaccccggaaccgtcggtaccaccgtcnccggaccg

SEQ ID NO: 303836 - DNA, 555 bp, Homo sapiens
  misc_feature: GZ8MTXP02FZK42.45.5.A05.1.454.CMB.2.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcggccgccatctcctgcacgtctagtcggancctcttacatacaaatggaaagtacttattgtactggtacctgcagaggccaggccagtcgccgnagctctagtccagcaggcttcgacgtccggtcctggatgtcagacaggttcaggttggcacgggatcgaagacactattcctttcactctagaaaactcaagtccgtgtcggccgcgtagaggtagttggttggttgtttagttgcttggcctagtgactaaagtcgtacgtacggtaccggtacgtaccggtttcggggcccgggggtaaccagggtcgtagggacggttaccgaagtacggaacgtggtcggtcgtacggcaaccg

SEQ ID NO: 303837 - DNA, 527 bp, Homo sapiens
  misc_feature: GZ8MTXP02HH7TW.45.5.A05.1.454.CMB.2.raw
  modified_base (321)..(321): a, c, t, g, unknown or other
  misc_feature (321)..(321): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagtacttattgtactggtacctgcagaggccaggccagtcgccgcagctcctagtccagcaggcttccagtcgttccnggatcgtcagacaggttcaggtggacacgggatcagacacatcttcactactagaaatcgagccgtgtcggccgctgaggtatggtttggtgtttatactgctatgacaagtctagtacgtaccggtactaccggttcgggcccggggacagggcgtgggacgtcgtaaacgtcggtaacgtcggtcggccgtcgaccgacctacg

SEQ ID NO: 303838 - DNA, 547 bp, Homo sapiens
  misc_feature: GZ8MTXP02HIBSE.45.5.A05.1.454.CMB.2.raw
  modified_base (311)..(311): a, c, t, g, unknown or other
  misc_feature (311)..(311): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaaagaacggtcaaccgtggcgggtcctgaggctctctgtttaggtctggattcgtctcagcgactactacctgagtggtccgctggctcgagggagngtctggagtggattggcgtacatcagtctattctgacttcgaccgtctactacgcagctctgtggagggcctattccacacttccaggacgacgccgcgactcacttatctgcagatgactagtctagacgaccgaacgacacggaccaatatacttactgtcgcgcgaggtacgttaacgtcggtcgtccggtcggggcccgggtaacccgtcggtaccgaccgtccgtccgccg

SEQ ID NO: 303839 - DNA, 550 bp, Homo sapiens
  misc_feature: GZ8MTXP02IP79J.45.5.A05.1.454.CMB.2.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttcctgctattattataaaaggtgtcctgtgtcaggtacagatggcggagtcgtgggggaagaacggtcaaccctggcgggtccctgaggctctcctgttaggtctggattcgtcttcagcgactactacctgagttggccgntggctccgagggangtctggagtggattgcgtacntcagtcattctgacttcgaccgtctaactacgcagctctggtcgggagggcccgtaattccaacctactttccgaggacgacgcccgacgactcactttactctgcagatgactagtctgacgaaccgaagacgacggccaagtatatactgtgcgacgaggtacgttaacgtcggccgtccgtcggggcccggaaccgtcggccaccgtcctccgccg

SEQ ID NO: 303840 - DNA, 544 bp, Homo sapiens
  misc_feature: GZ8MTXP02ICCAZ.45.5.A05.1.454.CMB.2.raw
  modified_base (317)..(317): a, c, t, g, unknown or other
  misc_feature (317)..(317): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatgggcggagtcgtgggggaagaacggtcaaccctggcgggtccctgaggctctcctgtttaggttctggattcgtcttcagcgactactacctgagttggccggctggctccgagggaangtctggagtggattgcgtacatcagtcattctgacttcgaccgtctactacgcagctctgtggaggccgattcaccattcaggacgacgcgcgactcactttatctgcagatgactagtctgacgacccgaagacacggccatatattactagtgcgcgaggagttaacgttggcgttccgtcgggggccccggggaaacccgtcgggtaccacccggtctccggcc

SEQ ID NO: 303841 - DNA, 505 bp, Homo sapiens
  misc_feature: GZ8MTXP02GKSK0.45.5.A05.1.454.CMB.2.raw
  modified_base (391)..(392): a, c, t, g, unknown or other
  misc_feature (391)..(392): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttattgtactggtacctgcagagccaggccagtcgccgcagctcctagtccagcaggcttccacgtccggttcctggagtcgtcagacaggttcagtggacacggatcgagacacatcttcactctagaaatcagcgtgtgcgnngagtatgtgtgtttatactgcagtgacaagctgtacgaccggtactaccggtttcgggaccgggggtacagggtcgtggaacgtcaagtcgaacgtggtcgctacgcacctag

SEQ ID NO: 303842 - DNA, 545 bp, Homo sapiens
  misc_feature: GZ8MTXP02GUYCI.45.5.A05.1.454.CMB.2.raw
  modified_base (315)..(315): a, c, t, g, unknown or other
  misc_feature (315)..(315): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggtctggattcgtcttcagcgactactacctgagttgggtccgctggctccgagggaanagtctggagtggattgcgtacatcagtcattctgacttcgaccgtctactacgcagctctggtggagggcccgattccaccatttccgagggacgacgccgcgaactcactttatctgcagatgactagtctgacgacccgagacacggccatatattactagtgcgcgaggacgttaacgtcggcgtccggtcggggcccgggaaccgtcggtccaccgtcctccgccg

SEQ ID NO: 303843 - DNA, 547 bp, Homo sapiens
  misc_feature: GZ8MTXP02ICZ7X.45.5.A05.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (398)..(398): a, c, t, g, unknown or other
  misc_feature (398)..(398): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttccttgctattattataaaaggtgtcctgtgtcaggtacagatgggcggagtcgtgggggaagaacggtcaaccctggcgggtcctgaggctctcctgttaggttctggtattcgtcttcagcgactactacctgaggttggccgntggctccgagggaagagtcgnggagtggattggcgtacatcagtcattctgacttcgaccgtctactacgcaagctctggtgggaggccgattcaccncttcgaggacgacgccgcgactctacttatctgcagatgactagtctagacgaccgaagacacggacatatattactgtgcgcgaggagttaacgtcggtcgtccggtcgggggcccggaaccgtcggtaccgtcccgtcgtcccgccg

SEQ ID NO: 303844 - DNA, 499 bp, Homo sapiens
  misc_feature: GZ8MTXP02IR8D1.45.5.A05.1.454.CMB.2.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttattgtactggtacctgcagaggccaggccagtcgccgnagctcctagtccagcaggcttccagccgttccnggagtgtcagacaggttcagtggacacggatcagacacatctttcactctagaaaatcagcgtgtggcgctgagatgttggtgttattactgcatgcaagctgtagaccggtactaccgtttcgggccgggggtaccgaggcgtgggacgtcaagtcgaacgtggtcggctcggcacta

SEQ ID NO: 303845 - DNA, 490 bp, Homo sapiens
  misc_feature: GZ8MTXP02HJ1FE.45.5.A05.1.454.CMB.2.raw
  modified_base (186)..(186): a, c, t, g, unknown or other
  misc_feature (186)..(186): n is a, c, g, or t
  modified_base (416)..(416): a, c, t, g, unknown or other
  misc_feature (416)..(416): n is a, c, g, or t
  modified_base (490)..(490): a, c, t, g, unknown or other
  misc_feature (490)..(490): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaanacttatttgtactggtacctgcagaggccaggccagtcgccgcagctcctagtccagcaggcttccagccggttcctggagtgtcagacaggttcagtggacacggatcagacacatctttcactctgaaaatcagccgtgtgccgctgagatgttggtgtttattactgcatgcaagctgtagacgtacaccgtttggccgggggacaggctggagtcaatcgaactgngctgcacagtctgtcttcactcttcccgctatctgactcgactcgcgtctgagcgggctggcacggcacatagn

SEQ ID NO: 303846 - DNA, 531 bp, Homo sapiens
  misc_feature: GZ8MTXP02I4FMC.45.5.A05.1.454.CMB.2.raw
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcggccgccatctcctgcacgtctagtcggagcctcttacatacaaatggaaagtacttattgtactggtacctgcagaggccaggccagtcgccgcagctcctagtccagcaggcttccgagtccgttcctgggatgtcagacaggttcaggtgacacggatcagacacattcttacactctagaaatcagcgngtcgcgntgagtatgtagtgtttatactgcagtgacaagtcgtagtaacggtaccgtacgtaccggtttcggggacccggggaccgagggtcgtagggtacggttacgaacgtcggtaacgtggttacggcttacgctaaccgtac

SEQ ID NO: 303847 - DNA, 495 bp, Homo sapiens
  misc_feature: GZ8MTXP02JAKEE.45.5.A05.1.454.CMB.2.raw
  modified_base (397)..(397): a, c, t, g, unknown or other
  misc_feature (397)..(397): n is a, c, g, or t
  modified_base (495)..(495): a, c, t, g, unknown or other
  misc_feature (495)..(495): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagcccggttccctggagtgtcagacaggttcagtggcacggatcagacacatctttcactctagaaaatcagccgtgtgccgntgaggatgttgtgtttatactgcatgcaagctgtagacgtacaccgtttgggccggggtacaggcgtggacggtcaagtcgactggtcgctcgcactn

SEQ ID NO: 303848 - DNA, 533 bp, Homo sapiens
  misc_feature: GZ8MTXP02GE0WU.45.5.A05.1.454.CMB.2.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtacttattgactggtacctgcagaggccaggccagtcgccgnagctcctagtccagcaggcttccgagtcccggttccnggagtcgtcagacagggttcaggttggacacggatcgagaccanattccttacactctagaaatcacgcgtgtcggccgcgtagagtagtgttggttgtttattactgcagtgacagtcgtagtacgtaccggtactaccggttcgggccgggggactagggcgtcgggacgtcgaacgtcgtaacgtggtacggcgtcgctacgtacg

SEQ ID NO: 303849 - DNA, 643 bp, Homo sapiens
  misc_feature: GZ8MTXP02JQOS6.45.5.A05.1.454.CMB.2.raw
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaacccgtggcgggtcctgaggctctcctgttaggttctggattcgtcttcagcgactactacctgagttgggccgntggctccggaggagngtgnggtgngtatgcgtanctcgagtactattcgtagtaccgttccgtaccgttactacgtacgacgaacgtccgtcgttgggtacgggggaccgggtacgttactcccgaaccgtttacgttaccggacggggacccgaccggcccgaaccgtacctaccttaactttactcgactacgagtagtacgtaacgttacgttcgtacggaaacccggaacccgaacgaccggaccggactaagtaacttactacggtgtacgcgtacggagttaacgttacgtcggaccgtcggcgggggacccgtacggtcgaccgtccgtccgcaccg

SEQ ID NO: 303850 - DNA, 572 bp, Homo sapiens
  misc_feature: GZ8MTXP02GFGTP.45.5.A05.1.454.CMB.2.raw
  modified_base (222)..(222): a, c, t, g, unknown or other
  misc_feature (222)..(222): n is a, c, g, or t
  modified_base (362)..(362): a, c, t, g, unknown or other
  misc_feature (362)..(362): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcaccctgggcagtcggccgccatctcctgcacgtctagtcggancctcttacataacaaatggaaagtcttattgtactggtacctgcagaggccaggccagtccgccgcagctctagtccagcaggcttcccgacgtcccggttccctgggagtcgtcagaccgtaggttcagtggacacggntcagacactattctttacactatagaaaactcgagtccgtagtcggccgtcgtaggaggtagttggtttgggttagtttattacgtgcaagttgacgaagtcgtagtacggtaccgtacgtaccggttcggggaccggggtaccgagggtcgtagggaacgtcgaaacgtcggaacgtggttacgctacggcctactacggttctttccg

SEQ ID NO: 303851 - DNA, 560 bp, Homo sapiens
  misc_feature: GZ8MTXP02JJ74Q.45.5.A05.1.454.CMB.2.raw
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (434)..(434): a, c, t, g, unknown or other
  misc_feature (434)..(434): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtctgggggaanaacgggtcaacccgtggcgggtccctgaggctctcctgtttaggttctgggattcgtcttcagcgactactacctgaggtttgggccggntggctccgaggggaangtctggagtggattgcgtacntcagtcattctgacttcgaccgtntactacgcagctcgtggtggacgggcctattcacctatttccgagggacacgccgcgactcactttanctgcagactgacttagtctagacgacccgaagacgacggacactatatactgtcgcgtacgaggtacgttaacgtcggcgtaccgtcgggggccccggtaaccgtcggcctaccggtcctccgccg

SEQ ID NO: 303852 - DNA, 542 bp, Homo sapiens
  misc_feature: GZ8MTXP02FJ153.45.5.A05.1.454.CMB.2.raw
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
tcagacgcgatcgacacgaccggtgctcgatttagatagatagacagggaagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaacccgtggcgggtccctgaggctctcctgtttaggttctggattcgtcttcagcgactactacctgagttggccgntggctccgagggangtctggagtggattgcgtacatcagtcattctgacttcgaccgtctactacgcagctctggtggagggccattcaccatttccgaggacgacgccgcgactcactttatctgcagatgactagtctgagacccgaagacacggcatatattactgtgcgcgaggtacgttaacgttcggccgtccggtcggggccccggtaacccgtcggtccaccgtccgtccgccg

SEQ ID NO: 303853 - DNA, 563 bp, Homo sapiens
  misc_feature: GZ8MTXP02HTPFD.45.5.A05.1.454.CMB.2.raw
  modified_base (315)..(315): a, c, t, g, unknown or other
  misc_feature (315)..(315): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggttctggattcgtcttcagcgactactacctgagttgggtccgctggctccgaggganagtctggagtggattgcgtacatcagtcattctgacttcgaccgtctactacgccagccttctggtgggacgggccgtattccacccatttccgagggacgacggcccgcgaactctactttatctgcagatgactagtctgacgacccgaagacacggcatactattactgtgcacgaggtacgttaacgtcggtaccgtccggtcggggccccggaaccgttcggacctaccggtccgtccgaccg

SEQ ID NO: 303854 - DNA, 562 bp, Homo sapiens
  misc_feature: GZ8MTXP02I7OAW.45.5.A05.1.454.CMB.2.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtacttatttgtactggtacctgcagaggccaggccagtcgccgcagctcctagccagcaggccttccagccgttccnggatcgtcagacaggttcagtgcaggatcagacactatctttcactctagaaaactcgagccgtgtcggccgcgtagagtattggtttggttgtttattactgacagtgactaagcgttagtaacgtaccggttacgtaccggtttcgggggacccgggggtaccgtaggggtccgtggggtaaacggttcgtaaaacgttccggtaaacgtgggttcggcgttacggcctaacccttag

SEQ ID NO: 303855 - DNA, 528 bp, Homo sapiens
  misc_feature: GZ8MTXP02F224M.45.5.A05.1.454.CMB.2.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggattttagtacggacattgcggtgacccagactccactctccctgtccgtcaccccgtgggcagtcggccgccatctcctgcacgtctagtcggancctcttacatacaaatggaaatacttattgactggtacctgcagagccaggccagtcgcgcagctctagtccagcagggccttcgagtcccggttccnggagtcgtcagacgaggttcaggttggacacggatcgagacactattctttacactactagaaaactcgacgtccgtgtggccgactggaggtagttggtttggttgttttagttactagacagtgactaagcgtagtacgaccggtactaccggttgggaccggggtacaggcgtggacgtcaagtcgacgtgcgctcgcactg

SEQ ID NO: 303856 - DNA, 576 bp, Homo sapiens
  misc_feature: GZ8MTXP02JMJFZ.45.5.A05.1.454.CMB.2.raw
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
  modified_base (439)..(439): a, c, t, g, unknown or other
  misc_feature (439)..(439): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccgtggcgggtcctgaggctctctgttaggttctggnttcgtcttcagcgactactacctgagttcgggtccggctggctccgaggggaagagtcgtggagtggattgcgtanatcagtctattctgtactcgaccgtctactcgcagtctcgtggtcgggacggccgtattccacctatttccgagggaccacgccgacgaactcactttcnctgcagatgactagtcgtagaacgaccgaagaccgaggacctatagtataacgtgtacgcgacgaaggtacgttaacgtcggtacgtccggtcggggaccccggtaacccgtggtaccctcccggtccgtccgaccg

SEQ ID NO: 303857 - DNA, 580 bp, Homo sapiens
  misc_feature: GZ8MTXP02HROXF.45.5.A05.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (565)..(565): a, c, t, g, unknown or other
  misc_feature (565)..(565): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtgggggaagaacggtcaaccctggcgggtcctgaggctctcctgtttaggtctggattcgtcttcagcgactactactgagttgggccggntggctccgagggagagtcnggagtggattgcgtanatcagtctattctgacttcgaccgttctactacgccagccttcgtggtgggacggggccgtatttccaaccctactttccgaggggtaccgaccggccgcgaaactctactttactctagcagtatgacttagtctagacgacccgaagacgacggcagtatattactgtgtcgacgaggtacgttaacgtcggtaccgtccggtcgggggccccggaaccgtcgggtaccnccggtccgtccgccg

SEQ ID NO: 303858 - DNA, 544 bp, Homo sapiens
  misc_feature: GZ8MTXP02JZ4FJ.45.5.A05.1.454.CMB.2.raw
  modified_base (353)..(353): a, c, t, g, unknown or other
  misc_feature (353)..(353): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcaccctgggcagtcgccgccatctcctgcacgtctagtcggagcctcttacatacaaatggaaagtcttattgtactggtacctgcagaggccaggccagtcgcgcagctctagtccagcaggccttccagtcccggttccctgggagtgtcaggacaggttcagtggacacggntcagacacattctttacactctagaaaactcagccgtgtggccgctgaggtatgttggtgtttatactgcagtgcaagtctaggtacgaccggttacgtaccggtttcgggccgggggtacgacgggcgtagggacggtcgaacgtaccgtaacgttggtacggtcgttcgaccgacccgtagtccgttcg

SEQ ID NO: 303859 - DNA, 494 bp, Homo sapiens
  misc_feature: GZ8MTXP02G4C7X.45.5.A05.1.454.CMB.2.raw
  modified_base (164)..(164): a, c, t, g, unknown or other
  misc_feature (164)..(164): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggancctcttacatacaaaatggaaagacttatttgactggtacctgcagaggccaggccagtcgccgnagctcctagtccagcaggcttcagcgtcctgagngtcagcaggttcagtggacacggatcagacacatctttcactctgaaaatcagccgtgtggccgctgagatgtggtatttattactgcatgcaagctgtagaccgtacaccgtttgggccgggggacaggctggaggtcaatcgaaacgtgtggctgcaccagtctgtcttcatccttcccgcctatctgatcgatcgcgtctgagcgggcgcggacgacggcncanagng

SEQ ID NO: 303860 - DNA, 599 bp, Homo sapiens
  misc_feature: GZ8MTXP02HV5IK.45.5.A05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcacccctgggcagtcggccnccatctcctgcacgtctagtcggancctcttacatacaaatggaaagacttatttgactggtacctgcagagccaggccagtcgccgcagctctagtcagcaggcttccagccgtttccnggacgtcgtcagacaggttcaggtggcacggatcgagacacattctttcaactctagaaaatcaagtccgtgtcggccgtcgtagaggtattggtttggttagtttttaattaccgttggactaagttgacgtaaagcgttagtaacgtacccggttacgtaccggttttacgggggacccgggggaaccctaggggtacccgttaggggaacggttacgtaaacgttaacggtaaaaccggttggttacggggacctttcggaccctaacccgttaacg

SEQ ID NO: 303861 - DNA, 519 bp, Homo sapiens
  misc_feature: GZ8MTXP02GV5PV.45.5.A05.1.454.CMB.2.raw
  modified_base (216)..(216): a, c, t, g, unknown or other
  misc_feature (216)..(216): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtgggggaanaacgggtcaacccgtggccgggtcctgaggctctcctgtttaggttctggtattcgtcttcagcgactactacctgagttggccgctggctccaggganagtctggagtggattgcgtacntcagtcatctgacttcgacctntactacgcagctctggtggaggccattcacattcaggacacgcgcgaactcacttatctgcagntgactagctgacgacccgagacgacggcatatattactgtgcgcggagagttactggcgtccgtggggcccggaactcggtccacgtccgtaccgc

SEQ ID NO: 303862 - DNA, 559 bp, Homo sapiens
  misc_feature: GZ8MTXP02FXTEN.45.5.A05.1.454.CMB.2.raw
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttccttgctattattataaaaggtgtcctgtgtcaggtacagatggcggagtcgtgggggaagaacggtcaacccgtggcgggtccctggaggctctcctgtttaggttctggattcgtcttcagcgactactacctgagttgggtccgntggctccgagggaagngtctggagtggattgcgtanatcagtcattctgacttcgaccgtctactacgcagctcgtggtggagggccattccgacctattccgagggacgacgcccgacgaactcactttancctgcagntgactagtctagagacccgagaccacggccatatattactgtcgcgcgaggtacgttaacgtggccgttccgcgggggaccccggtaaccgtcgggtaccaccggtcctccggacc

SEQ ID NO: 303863 - DNA, 629 bp, Homo sapiens
  misc_feature: GZ8MTXP02F6IDU.45.5.A05.1.454.CMB.2.raw
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatgagtttgggctgagctgggttttccttgctattattataaaaggtgtcctgtgtcaggtacagatggcggagtcgtgggggaagaacggtcaacccgtggcgggtccctgaggctctcctgtttaggtctggattcgtcttcagcgactactacctgagttggccgntggctcgagggangtcnggagtggattggctacatcgtagtctattctgtacttccgaccgtctactacgcagtcctctggtgggacggggtccctagtttccacctacgttccgaagggacgaccgccgacgaaacctcctaactttactctagcaggtatagacttagtctacggacgaaccccgaagaccgacggccaataacttagttactggtcgacggtacggtaagggtacgtttaaacgttcgggccggttacccggtaaccggggggtacccccggtaacccggttcggggtaccctacccggttcccgtacccgtacccg

SEQ ID NO: 303864 - DNA, 536 bp, Homo sapiens
  misc_feature: GZ8MTXP02IV16E.45.5.A05.1.454.CMB.2.raw
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattatataaaaggtgtcctgtgtcaggtacagatggcggagtctgggggaagaacggtcaaccctggcgggtcctgaggctctcctgttaggttctggattcgtcttcagcgactactacctgagttgggtccggctggctccgaggggaagagtctggagtggattggcgtacatcagtcattctgacttcgaccgtctactacgcagctctggtggaggccgattcaccattccaggacgacgccgcgaactcactttatctgcagatgactagtctgacgacccgaagacacggccagtatattactgtgcgcggaggtacgttaacgtggcgtcgtcggggcccggaaccgtcggccaccgtctccgcg

SEQ ID NO: 303865 - DNA, 533 bp, Homo sapiens
  misc_feature: GZ8MTXP02IG4E1.45.5.A05.1.454.CMB.2.raw
  modified_base (186)..(186): a, c, t, g, unknown or other
  misc_feature (186)..(186): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (532)..(532): a, c, t, g, unknown or other
  misc_feature (532)..(532): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaanactttatttgactggtacctgcagagccaggccagtcgccgnagctcctagtccagcagcttccagccggttccnggatgtcagacaggttcagtggacacggntcagacacatctttcactctagaaaatcagccgtgtgccgctgagtatgttgtagtttattactgctatgacgaagtcgtagtaacgacgtactaccggttggggccggggacaggcgtaggagtacgatacgaacgtgtcggntgacaccttntctgttctctcttcctccnctactctagacttcgactcgtcgtcgtacggtcggcgggtaacgtcgggacgacggacgcgtaagtagng

SEQ ID NO: 303866 - DNA, 586 bp, Homo sapiens
  misc_feature: GZ8MTXP02G5PTV.45.5.A05.1.454.CMB.2.raw
  modified_base (273)..(273): a, c, t, g, unknown or other
  misc_feature (273)..(273): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtcctgaggctctctgttaggttctggattcgtcttnagcgactactacctgagttggtccactggctccgagggagagtctggagtggattggcgtacatcagtcattctgtacttcgaccgtctactacgcagctcgtggtggggacgggccgtattccacctacttccgagggaccgaccgccgaccgaactcgtaactttatctcgcagatagacttagtcgtagacgaacccgaagaccacggcatatattactgtcgcgacgaggtacgttacgtcggaccgtcccggtcgggggacccccggtaacccggtcgggtacccgtacccggttccgacccggtccg

SEQ ID NO: 303867 - DNA, 521 bp, Homo sapiens
  misc_feature: GZ8MTXP02IEPSF.45.5.A05.1.454.CMB.2.raw
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaaggtgtcctgtgtcaggtacagatggcggagtctgggggaagaacggtcaaccctggcgggtccctgaggctctcctgtttaggttctggattcgtcttcagcgactactacctgagttgggtccggctggctccagggaanagtctggagtggattgcgtacatcagtcattctgattcgaccgtntactacgcagctctgtggagggccgattcaccatttccaggacgaacgccgcgaacncacttattctncagangactagtctgacgaccgaacgaacacgacatatatactntgngcgagagtacgtacgtcgtcgtcggccggaccgcgcgcgctcgc

SEQ ID NO: 303868 - DNA, 556 bp, Homo sapiens
  misc_feature: GZ8MTXP02IISN2.45.5.A05.1.454.CMB.2.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
tcagacgcgatcgacacgaccggtgctcgatttagatagatagacagggggagctctgggagaagagcccccagccccagaattcccaggagtttccactcggtgatcagcactgaacacagaggactcaccatggagtttgggctgagcttgggttttccttgctattattataaaggtgtcctgtgtcaggtacagatgggcggagtcgtgggggaagaacggtcaacccgtgggccgggtccctgaggctctcctgtttaggtctggtattcgtcttcagcgactactactgagttggccgntggctcgaggganagtctggagtggattgctacatcagtcattctgacttccgaccgtctactacgcaagtctctggtgggacgggtccctattccacctattccgaggacgacgccgacgactactacttatctagcagatgactagtctagacgaccgaagacgacgacatactattactgtgcgcgaggtacgttacgtcggtcgtcggcggggtacccggacccgtcggtacctaccgtcgtccgcg

SEQ ID NO: 303869 - DNA, 538 bp, Homo sapiens
  misc_feature: GZ8MTXP02I8F4K.45.5.A05.1.454.CMB.2.raw
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggccgggtccctgaggctctcctgtttaggtctggattcgtcttcagcgactactacctgagttgggtccgctggctccgagggangtcnggagtggattgcgtacntcagtcattctgacttccgaccgtctactacgcagctcgtggtggacgggcctattcacctatttccgagggacgacgccgcgaactctactttatctgcagatcgacttagtctagacgacccgagacacggacatatatctgcgcgcgaggtacttacgtggcgtcgcggggcccggactcggtccaccgctccgacg

SEQ ID NO: 303870 - DNA, 572 bp, Homo sapiens
  misc_feature: GZ8MTXP02GRBI6.45.5.A05.1.454.CMB.2.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctggaggctctcctgtttaggttctggtattcgtcttcagcgactactactgagttggtccgctggctccgagggaangtctggagtggattgcgtacntcagtcattctgacttcgaccgtctactacgcagctcgtggtgggacggggcccagtttccaaccctacgtttccacggggtacgaccggccgcgaacctctactttatctgcagatgacttagtctaggacgacccgaaagaccacggaccagtatactactgtcgcgcggaggacgttacgtcggcggtccgcgggggccccggtaccgtcggaccgtaccgtccgtccgccg

SEQ ID NO: 303871 - DNA, 563 bp, Homo sapiens
  misc_feature: GZ8MTXP02JPCQ3.45.5.A05.1.454.CMB.2.raw
  modified_base (315)..(315): a, c, t, g, unknown or other
  misc_feature (315)..(315): n is a, c, g, or t
  modified_base (431)..(431): a, c, t, g, unknown or other
  misc_feature (431)..(431): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgttaggttctggtattcgtcttcagcgactactacctgagttggccgctggctccgagggangtcgtggagtggattgcgtacatcagtcattctgacttcgaccgtctactacgcagtctctggtcgggagggccgtattcacctattccgagggacgacgcgcgactcactttacnctgcagatgactagtctagacgacccgaagacacggcctagtatatactgtagcgacggaggtacgttacgttcgggaccgttccggtcgggggacccccggtaccgtcgggtccaccggtccgtccgaccg

SEQ ID NO: 303872 - DNA, 576 bp, Homo sapiens
  misc_feature: GZ8MTXP02JE6WS.45.5.A05.1.454.CMB.2.raw
  modified_base (318)..(318): a, c, t, g, unknown or other
  misc_feature (318)..(318): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctggaggctctcctgtttaggtctggattcgtcttcagcgactactactgagttgggtccgctggctccgagggaangtcgtggagtggattgcgtacatcagtcattctgtacttcgaccgtctactacgcagcctcgtggtgggaggggcctattccacctatttccgagggaccgacgcccgcgaacctctactttatctgcagatgtacttagtctaggacgacccgaagacgacggcatatatacgtgtagcgacggtaggtacgtttacgtgggtccggtccggtcgggggaccccgggtaaccgtcgggtccaccggtccgtccgccg

SEQ ID NO: 303873 - DNA, 516 bp, Homo sapiens
  misc_feature: GZ8MTXP02IRC1S.45.5.A05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcgccnccatctcctgcacgtctagtcggancctcttacataacaaatggaaagtacttattgactggtacctgcagaggccaggccagtcgccncagctcagtccagcaggctcagccgttccnggatcgtcagacaggttcagtgacacggatcagacacattcttacactctagaaactcagcgtgtcggaccgcgtagaggtattggttggttagtttatactgatatgactaagcgtagtacgaccgtactaccggtttgggaccggggaccagggcgtaggacggtacaacgtcgaacgtgtacggctcgactacctacg

SEQ ID NO: 303874 - DNA, 566 bp, Homo sapiens
  misc_feature: GZ8MTXP02G6AWJ.45.5.A05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtcccgtcacccctgggcagtcggccnccatctcctgcacgtctagtcggancctnttacatacaaatggaaagtcttattgtactggtacctgcagacgccaggccagtcgccgcagctcctagtccagcaggcttccgagccgttccgnggatcgtcagctaggttcaggtcgacacggatacagacactacttcttacactactaagaaactcgacgtccgtcggtcggccgtcgtaggaggtagttggtttaggtttagtttacgttacgtgactacgtacgacgtaagtcgtaggtaaccgtaccggtacgtaccggttcggggaccggggaccgacggtacgtacggacgtacgaacgtaacgaacgtggtacgacgtacgacactcg

SEQ ID NO: 303875 - DNA, 618 bp, Homo sapiens
  misc_feature: GZ8MTXP02HAN9E.45.5.A05.1.454.CMB.2.raw
  modified_base (561)..(561): a, c, t, g, unknown or other
  misc_feature (561)..(561): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggagcctcttacatacaaatggaaatacttattgtactggtacctgcagacgccaggccagtcgccgcagcctcctagtccagcaggtccttcccgacggtccccgggttcccctgggtacgtcgtacgaaccggaccgtagggtttccaggtcggaaccacgggtatcgaagaacctactactttcctttacaccttactaacgaaaacttcgaacggtccggttggtacggcccgtagtaggtaagggtagttgggtttaggttagttttaattacgtgtactagtgacgtaagtcgttaggtacgtaccggttacgtacggttcggggaccggggtacnggacgtagggacgtacaacgtcgaacgtggtcggacgtcgccacgtacgtcgttacg

SEQ ID NO: 303876 - DNA, 539 bp, Homo sapiens
  misc_feature: GZ8MTXP02HRVU1.45.5.A05.1.454.CMB.2.raw
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
  modified_base (538)..(538): a, c, t, g, unknown or other
  misc_feature (538)..(538): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggatgtcagacnggttcagtggacacggatcagacacatctttcactctagaaaatcgagccgtgtcggccgctggagntgttggttagtttattatgcatgcaagctagtacgaccgtactaccggtttcgggcccgggggaccngggtcgtgggtacggtacaagtcgaacgtggtggctgcaccatcgtgtccttcactccttcccgctatctgactcgtactccgtcgtcgtcggacggcgggcgtcgggacgaacggcgacgtagtagng

SEQ ID NO: 303877 - DNA, 619 bp, Homo sapiens
  misc_feature: GZ8MTXP02JWHDH.45.5.A05.1.454.CMB.2.raw
  modified_base (226)..(226): a, c, t, g, unknown or other
  misc_feature (226)..(226): n is a, c, g, or t
  modified_base (329)..(329): a, c, t, g, unknown or other
  misc_feature (329)..(329): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggancctcttacatacaaatggaaagtcttatttgtactggtacctgcagagccaggccagtcgccgcagctcctagtccagcaggccttccgagtcccggttcccnggatcgtcagtacaggttcaggttggacacggatcgagaccactattccttacactatagaaaatcgagtaccgtgtcggccgtcgtagaggtagttggtttggttagttttaattacgtggtactagtacgtacgtaaggtcgttacggttaacggtacccgggttaacgttacccgggtttacgggggacccgggggaaccgtacggggtcggtacggggtacggttaaccgtaacggttaaccggaaaccgttcgggttacggggccttacggaccgtaaccgttcg

SEQ ID NO: 303878 - DNA, 532 bp, Homo sapiens
  misc_feature: GZ8MTXP02H36VS.45.5.A05.1.454.CMB.2.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (481)..(481): a, c, t, g, unknown or other
  misc_feature (481)..(481): n is a, c, g, or t
tcagacgcgatcgacacgaccggtgctcgatttagatagatagacaggggagctctgggagaagagccccagccccagaattcccaggagtttccactcggtgatcagcactgaacacagaggactcacatggagtttgggctgagcttgggttttccttgcttattattaataaaaggtgtcctgtgtcaggtanagatgggcgagtcgtagggggaaagaacggtcaaccgtggcgggtcctgaggctctctgttaggttctggattcgtntcagcactactacngaggttggcgntggctccgagggaangtcgtggagtggattgcgttacagttcagtctattctgaaccttcgaaccgtntaactacgcagccttgtgnggacggccattcactattccgaggacgcgcgcgaactcactttanctgacagntgactagntagacgaccgaagacgacggtacaatatatactgngcgcgagagtacgtacgtcgcgtcggccggaccgcgtcgaccgctacgccg

SEQ ID NO: 303879 - DNA, 535 bp, Homo sapiens
  misc_feature: GZ8MTXP02JIZ1R.45.5.A05.1.454.CMB.2.raw
  modified_base (217)..(217): a, c, t, g, unknown or other
  misc_feature (217)..(217): n is a, c, g, or t
  modified_base (309)..(309): a, c, t, g, unknown or other
  misc_feature (309)..(309): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaaccctggcgggtcctgaggctctctgttagtctggattcgtcttcagcgactactactgagttggccgctggctccgagggagngtctggagtggattgcgtacatcagtcattctgacttcgaccgtctactacgcagctcnggtggaggccattcgacctattcagggacacgccgcgaactccactttanctgcagactgactagtctggacgacccgaagacacggcatatattactgtgcgacgaggtacgttaacgtcggacgtccgtcggggcccggtaaccgtcgggccaccgttcaccgcg

SEQ ID NO: 303880 - DNA, 549 bp, Homo sapiens
  misc_feature: GZ8MTXP02JZVYS.45.5.A05.1.454.CMB.2.raw
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (437)..(437): a, c, t, g, unknown or other
  misc_feature (437)..(437): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaggtgtcctgtgtcaggtacagatggcggagtcgtggggggaagaacggtcaacccgtggccgggtccctgaggctctctgtttaggtctggattcgtcttcagcgactactacctgagttgggtccgntggctccgagggangtctggagtggattgcgtacatcagtcattcngtacttcgaccgtctactcgcagctcgtggtgggacgggtccatttccacctactttccgagggaccgacgcccgcgaactcactttacnctgcagatgactgtctagacgaccgagacgacgcatatatactgtgcgcgaggtacgttacgtcggtcgtccggtcggggccccggaccgtcggtaccaccggtcgtccgcg

SEQ ID NO: 303881 - DNA, 696 bp, Homo sapiens
  misc_feature: GZ8MTXP02HFO7Y.45.5.A05.1.454.CMB.2.raw
  modified_base (348)..(348): a, c, t, g, unknown or other
  misc_feature (348)..(348): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtagggggaagaacggtcaacccgtggcgggtccctggaggctctcctgttaggttctggattcgtcttcagcgactactacctgagttgagtccggctggcctcgagggaagagtcgtagggagtggattggacgttaacntcaagtcatttctagacttccgaccgtcttacgtacgcagtaccttgtcggtagggacgggtcctattccaccctatttacccggaacggggaccgaaccggcccgtacgaaaccttcctaacttttacctcgtacgactagtacgtacgtaacgttagtacgaacggaaccgaaacccggaaagaaccgaaccgtacctaaattaacttaacgttacgtacggttacggaccggtaacgggtaaacgggttaacgtttaaccggtcggggtacccggttaacccggggtacccgggggtaacccccggtaacccggtcgggtacccgtaccccggttccgtacccgg

SEQ ID NO: 303882 - DNA, 498 bp, Homo sapiens
  misc_feature: GZ8MTXP02HWVLX.45.5.A05.1.454.CMB.2.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (407)..(407): a, c, t, g, unknown or other
  misc_feature (407)..(407): n is a, c, g, or t
  modified_base (498)..(498): a, c, t, g, unknown or other
  misc_feature (498)..(498): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaagactttatttgtactggtacctgcagaggccaggccagtcgccgnagctcctagtccagcaggcttccagccggttccctggagtgtcagacnggttcagtggacacggatcagacacatctttcactctgaaaaatcagccgtgtggccgctgaggatgttggtgtttattactgcatgcaagctagtagaccggtacaccgtttggccgggggacaggcnggaggtcaatcgaactgtggctgcaccatctgtcttcatcttccgctatctgatcgatcgctctcgagcgggctggacaaggcgacatagn

SEQ ID NO: 303883 - DNA, 553 bp, Homo sapiens
  misc_feature: GZ8MTXP02JDUBB.45.5.A05.1.454.CMB.2.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (428)..(428): a, c, t, g, unknown or other
  misc_feature (428)..(428): n is a, c, g, or t
tcagacgcgatcgacacgaccggtgctcgatttagatagatagacaggggagctctgggagaagagccccagccccagaattcccaggagtttccactcggtgatcagcattgaacacagaggactcaccatggagtttgggctgagctgggtttccttgctattattataaaaggtgtcctgtgtcaggtacagatggcggagtcgtgggggaagaacggtcaaccgtggcgggtcctgaggctctcctgttaggttctggattcgtcttcagcgactactacctgagttgggtccgntggctccgagggaagagtcgtggagtggattgcgtacatcagtcattcngtacttcgaccgtcactacgcagctctggtggagggcctattcacctattccgaggacgacgccgacgaactcactttanctgcagatgactagtctgacgaccgaagacgacgcatactatactgtgcgacgaggtacgttaacgtcggaccgtccggtgggggaccccggtaaccgtcggtaccgacccgttccgccggaccg

SEQ ID NO: 303884 - DNA, 559 bp, Homo sapiens
  misc_feature: GZ8MTXP02FZHXL.45.5.A05.1.454.CMB.2.raw
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtccctgaggctctcctgtttaggtctggattcgtcttcagcgactactacctggagttgggtccgctggctccgaggganagtcgtggagtggattgcgtacatcagtcattcngacttcgaccgtntactacgcagctgtggtgggaggccgtattccacctatttccgagggacgacgccgcgaactcactttanctnctagatgactagtctagacgacccgagacacgcatatatactgtcgcgcgaaggtacgtaacgttggccggttaccgcgggggtaccccggtaaccgtcgggcccacccggtccgtaccgccg

SEQ ID NO: 303885 - DNA, 529 bp, Homo sapiens
  misc_feature: GZ8MTXP02JSZ9D.45.5.A05.1.454.CMB.2.raw
  modified_base (226)..(226): a, c, t, g, unknown or other
  misc_feature (226)..(226): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggancctcttacatacaaatggaaagacttattgtactggtacctgcagaggccaggccagtcgccgcagctcctagtccagcaggccttccagcccggttcctggatcgtcagactaggttcagtggacacggatcagacacattcttcactctagaaaatcagccgtgtggccgcgtgagtagttgttggttgtttattactgcagtgactaagctagtacgtaccgtacgtacgtttcggggaccggggtaccgagggcgtaggacggtacaagtcgaacgtggtcggactcggacctactacg

SEQ ID NO: 303886 - DNA, 546 bp, Homo sapiens
  misc_feature: GZ8MTXP02HS412.45.5.A05.1.454.CMB.2.raw
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatgggcggagtcgtgggggaagaacggtcaaccgtggcgggtcctgaggctcncctgttagtctggattcgtntcagcgactactacngagttggccgntggntcagggangtcnggatggattggctanatcagtcattctgacttcgacctctactacgcagcctcngtggacgggccctattcaccatttccgaggaccgacgcccgcgaactctactttatctagcananagtacgtagtactagacgaccgaacgacgacgaccatatatactacgtgtcgcgaaggtagtaacgttcggtacgtcgtcgggtaccgggaccgtcggtacgaccgtccgtccgccg

SEQ ID NO: 303887 - DNA, 568 bp, Homo sapiens
  misc_feature: GZ8MTXP02G1QQZ.45.5.A05.1.454.CMB.2.raw
  modified_base (313)..(313): a, c, t, g, unknown or other
  misc_feature (313)..(313): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctctgttaggtctggattcgtcttcagcgactactacctgaggttggccgctggctccgaggganagtctggagtggattggcgtacatcagtctattctgacttcgacctctactacgcagcctctggtggagggccgtattccacctatttccgagggaccgacgccgacgaactctacgtttatctgacagatgaactagtctaggaacgacccgaagaccgacggccatactattaacgtgtacgcgacgaggtacgttacgtcggccgtccggcgggggaccccggtaccgtcggacctaccgtccgtaccgccg

SEQ ID NO: 303888 - DNA, 638 bp, Homo sapiens
  misc_feature: GZ8MTXP02GFXG5.45.5.A05.1.454.CMB.2.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (275)..(275): a, c, t, g, unknown or other
  misc_feature (275)..(275): n is a, c, g, or t
  modified_base (637)..(637): a, c, t, g, unknown or other
  misc_feature (637)..(637): n is a, c, g, or t
tcagacgcgatcgacacgaccggtgctcgatttagatagatagacagggagagtggagtctggatccctggatttagtacggacattgcggtgacccagactccactctccctgtccgtcacccctggcagtcgccgccatctcctgcacgtctagtcggancctcttacatacaaatggaaanactttatttgtactggtacctgcagagccaggccagtcgccgcagctcctagtccagcaggcttccagccggttccctggagtgtcagacnggttcagtggacacggatcagacacattctttcactctgaaaatcacgccgtgtcggccgtctacgaggattggttggttacgttttattaactggactaagttgacctaaaggtctagtaacggtaaacccggttacgttaaacccggttttcgggggaccccgggggtacccgaagggtccgttgggggaacggttcaacgttacgtaaacgtggttcgggcttacggccaaaccccggttacgttaccgtacgttacctttaccgtaccgtttccccgttcccgtacctagttcctagtacgtacgtacgtcgtcgtcgtcggacggtcggtcgtcggacgtacggcgtacgacgtcgng

SEQ ID NO: 303889 - DNA, 586 bp, Homo sapiens
  misc_feature: GZ8MTXP02GCBD2.45.5.A05.1.454.CMB.2.raw
  modified_base (341)..(341): a, c, t, g, unknown or other
  misc_feature (341)..(341): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaggtgtcctgtgtcaggtacagatggcggagtcgtgggggaagaacggtcaacccgtgggcgggtccctgaggctctcctgtttaggtctggtattcgtcttcagcgactactacctggaggttcggtccgctggctccgagggaagagtctggagtggattggcgtanatcagtcattctagactttccgaccgttctaactacgcagcctctggtggaggggcctaagtttccacctactttcccgaagggaccgacgccgccgtaaactcctaactttatcctgtcagatgactagctagacgacccgagacacggacatatatacgngtcgcgngtaggacgtttaacgtcgggaccgttccggtcgggggccccggtaacccgtcgggtacccgaccgtcgtccggacg

SEQ ID NO: 303890 - DNA, 525 bp, Homo sapiens
  misc_feature: GZ8MTXP02ISEEH.45.5.A05.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
  modified_base (424)..(424): a, c, t, g, unknown or other
  misc_feature (424)..(424): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaancttatttgactggtacctgcagaggccaggccagtcncgnagctcagtccagcaggctccagtccgtccnggatgcngacnggttcagtggcaggatcagacanattctttcactactagaaaatcaacgtccgtgtcgccgctggagtagttggttggttgtttagttactggcagtnacagctagtacgacggtacgtaccgtttgggaccggggacgtacgggacgtagggacggtacgtaacgtaacgtaacgtggtcggactcggacacccgtag

SEQ ID NO: 303891 - DNA, 611 bp, Homo sapiens
  misc_feature: GZ8MTXP02GXCY1.45.5.A05.1.454.CMB.2.raw
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgtttaggttctggtattcgtcttcagcgactactactgagttggccgntggctcgaggganagtcnggagtggattgcgtacatcagtcattctgacttcgacgtcactacgcagctctggtggaggccatcacctattcgagggaccgacgccgacgtaaactcctacttacgtctacgcaaggtataggaacttggtacttagggaaccgaaacccgaaaggaaccgacggacctaaattactaacttaacgtgtcgaccgacggtaaaggtaacgtttaacgtcgggtccgttaccggtccgggggacccccggtaaacccgttcggggtaccctaccggtcccgtcccggaccg

SEQ ID NO: 303892 - DNA, 586 bp, Homo sapiens
  misc_feature: GZ8MTXP02HAQVX.45.5.A05.1.454.CMB.2.raw
  modified_base (315)..(315): a, c, t, g, unknown or other
  misc_feature (315)..(315): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtgggggaagaacggtcaacccgtggccgggtccctggaggctctcctgtttaggttctggattcgtcttcagcgactactacctgagttggccgctggctcgaggganagtcgtggagtggattggcgttacatcagtcattctgacttcgaccgtctactcgcagctctggtcggaggccgattccactactttccgacgggacgacgcccgcgaactctactttatcgtancgangtacgacgtagtcgtagaacgaacccgaagacgacggacctatatactacgtgtacgcggacggtaggtaacgttaacgttcgggaccgttccggtcgggggccccggtaacccgtcgggtaccgcccgtccgtcccggccg

SEQ ID NO: 303893 - DNA, 593 bp, Homo sapiens
  misc_feature: GZ8MTXP02H353N.45.5.A05.1.454.CMB.2.raw
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (458)..(458): a, c, t, g, unknown or other
  misc_feature (458)..(458): n is a, c, g, or t
  modified_base (524)..(524): a, c, t, g, unknown or other
  misc_feature (524)..(524): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgtttaggttctggattcgtcttcagcgactactacctgagtttgggccggctggctccgagggaanagtctggagtggattgcgtacntcagtcattctgacttccgaccgtctaactctacagcctcgtgtcgggacgggtccgatttccaacctatttacccgaggggtaccgaccgcccgacgaaaccttctacttttaacnctgacgtagtagtacgtacgttagtcgtacggacgaaccgaacgacgacgactatactacttacgngtgcgacgaggtacgttacgtcggtcgtccggtcggggacccggtaccgtcggaccgtaccgtcaccgc

SEQ ID NO: 303894 - DNA, 589 bp, Homo sapiens
  misc_feature: GZ8MTXP02FLIV1.45.5.A05.1.454.CMB.2.raw
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtgggcgggtccctgaggctctcctgtttaggtctggattcgtcttcagcgactactacctgagttcggtccggctggctccgagggangtctggagtggattgcgtanatcagtcattctgacttcgaccgtctactacgcacgctcgtggtgggacggccgtattccacctactttccgaggggaccgaccgccgacgaactcctactttactctgcagactgactagtcgtagacgacccgaagaccacggacatatattacgtcgtcgcggcggtaggtacgttacgtcggccggttaccggtcgggggtaccccggtaacccggtcgggtacccgaccggtccgtacccggaccg

SEQ ID NO: 303895 - DNA, 526 bp, Homo sapiens
  misc_feature: GZ8MTXP02GNPB0.45.5.A05.1.454.CMB.2.raw
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagacggacattgcggtgacccagactccactctccctgtccgtcacccctgggcagtcggccgccatctcctgcacgtctagtcggancctcttacataacaaatggaaagacttattgactggtacctgcagaggccaggccagtcgccgcagctctagtccagcaggctcagcgtccnggatcgcagcaggttcagtggcacgggatcagacacatcttcactctagaaaancagccgtgtgccgctgagattgtggttgtttattactgcatgacaagtcgtagtacgtaccggtactaaccgtttcggggaccgggggtaccagggccgttacgggacgggttaccaaagtaacgtaacgttacggtcggtccgtcggaccactaacg

SEQ ID NO: 303896 - DNA, 560 bp, Homo sapiens
  misc_feature: GZ8MTXP02HCQMS.45.5.A05.1.454.CMB.2.raw
  modified_base (309)..(309): a, c, t, g, unknown or other
  misc_feature (309)..(309): n is a, c, g, or t
  modified_base (442)..(442): a, c, t, g, unknown or other
  misc_feature (442)..(442): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttcctgctattattataaaggtgtcctgtgtcaggtacagatggcggagtcgtgggggaagaacggtcaacccgtggcgggtcctgaggctctcctgttaggtctggattcgtcttcagcgactactacctgagttggccgctggctccgagggangtctggagtggattggcgtacatcagtcattctgacttcgacctctactacgcagctcgtggtgggacgggccgtattccaaccctagtttcccgaggggaccgacgcccgacgaactcactttatctgcagntgactgtctagacgacccgagacgacggacatatattactgtcgcgcgaggtacgttacgtcggccgtaccggtcggggaccccggtaacccgtcggtaccacccggtcgtcccgccg

SEQ ID NO: 303897 - DNA, 597 bp, Homo sapiens
  misc_feature: GZ8MTXP02GBZUW.45.5.A05.1.454.CMB.2.raw
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagagtggcggagtcgtgggggaanaacggtcaacccgtggcggtcctgagctctctgttaggtctggattcgtcttcagcgactactacctgacgttgggccgntggctcgagggaangtcnggagtggattgcgtacatcagtcattcngtacttccgaccgttctactacgcagctcgtaggtggacgggcctatttccactattccgacggacgacgccgacgactctacttactctgcccagtatacgtacgtacgtacgtacggacgaacccgaacgacgacggacctaataactacttacgtagtacgcggacggtaacggtaacggttaacgttcggtccggtccgggtcccgggggtacccggtaccggtccggtccgtaccgtccgtaccgcccg

SEQ ID NO: 303898 - DNA, 688 bp, Homo sapiens
  misc_feature: GZ8MTXP02JC89Y.45.5.A05.1.454.CMB.2.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttcctgctattattataaaaggtgtcctgtgtcaggtacagatggcggagtcgtgggggaagaacggtcaaccctgggccgggtccctgaggctctcctgtttaggtctggattcgtcttcagcgactactacctgagttgggccgntggctcagggangtctggagtggattgcgtacatcagtcattctgacttcgaccgtntactacgcagctcgtggtcggacgggcctatttccaccctagtttcccgaaggggtacccgacggcccgacgtaaacctcgtaaccttttacgtccgttagccgtaaaggtaagttacggaactttacgggttacccgttaacgggaaaaccgtaaccccccgggaaaaggtaaacccgaaccggggtaacccctaattaaccgttaaaattcccgtaagggttcgaccggtcggtaaagggtacgtttaaaccgtcggggtacccgttccggtccgggggtacccccggtaaaccccggtcgggtacccgaaccggttccgcccgacccg

SEQ ID NO: 303899 - DNA, 605 bp, Homo sapiens
  misc_feature: GZ8MTXP02I8N07.45.5.A05.1.454.CMB.2.raw
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggancctcttacataacaaatggaaagacttattgtactggtacctgcagagccaggccagtcgccgnagctctagtccagcaggcttccgagtccggttccnggagtcgtcagactaggttcagtggacacgggatcgagacatattctttacactctagaaaatcaacgtcgtggtcgccgtcgtaggaggtagttggtttgggtagttttaagttacctggtactaagttcggactaaaggtccgtaggtaacggtacccggttaaccgtaaccggtttccgggggacccgggggtaccgtacggggtaccgtacgggtaacggttacgaaacgttcggtaaaccggttggtacggtccgttacggaccgtaccctaacg

SEQ ID NO: 303900 - DNA, 595 bp, Homo sapiens
  misc_feature: GZ8MTXP02FURT5.45.5.A05.1.454.CMB.2.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (457)..(457): a, c, t, g, unknown or other
  misc_feature (457)..(457): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttcctgctattattataaaaggtgtcctgtgtcaggtacagatggcggagtcgtagggggaagaacggtcaacccgtggcggtcctgagctctctgtttaggtctggtattcgtcttcagcgactactacctgaggttggccgctggctcgagggagngtgtggagtggattgctacntcagtcattctgtacttccgaccgtctaccgtacgcagtcctcgtggtaggggacgggcctattccacctacttccgagggaccgaccgccgacgtaacctcctactttactctagctaagtntgtactagtctaggaaccgaacccgaagaccgacggaccatatattactggtgccgaggtaggtacgttacgtcgggccgttccgggtaaccgggggtccccggtaaccgtcggtacccgtaccgtccgtcccgaccg

SEQ ID NO: 303901 - DNA, 581 bp, Homo sapiens
  misc_feature: GZ8MTXP02I6BPM.45.5.A05.1.454.CMB.2.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccgtggcggtcctgagctctcctgttaggtctggtattcgtcttcagcgactactacctgagttggccgntggctccagggagngtcgtggagtggatgcgtacatcagtctattcngacttcgaccgtctactcncagcctnggnggacgggcctatccacctattccgaggaccgacgccgcgactctacttatctgacagtatgacttagtcgtagacgaacccgaagacgaccggactatatacttactgtgtcgacgtaggtaacgtttaccgttggaccggttcccggtcgggggtacccccggtaacccggttccgggtcccgtacccggttcccgtcccggtacccg

SEQ ID NO: 303902 - DNA, 559 bp, Homo sapiens
  misc_feature: GZ8MTXP02IV4EN.45.5.A05.1.454.CMB.2.raw
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
  modified_base (319)..(319): a, c, t, g, unknown or other
  misc_feature (319)..(319): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccnccatctcctgcacgtctagtcggagcctcttacatacaaatggaaanacttattgtactggtacctgcagaggccaggccagtcgccgcagctcctagccagcaggccttccagccgtccnggatcgtcagcaggttcaggtgacacggatcagacacattcttacactactagaaaatcgaacgtccgtgtcggccgtacgtaggagggtattggtttaggttaggtttttattacgtgtacgagttgacgtaaagtcgttaggtaacggtaccgttaacgtaccggtttcgggacccgggggtaacgacggtcgtaggacggttacgaacgtcgaacgtgtcggctcggactaccgtag

SEQ ID NO: 303903 - DNA, 612 bp, Homo sapiens
  misc_feature: GZ8MTXP02F0W03.45.5.A05.1.454.CMB.2.raw
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaaccgtggcgggtcctgaggctctctgtttagtctggtattcgtcttcagcgactactacctgagttgggccgcgtggctccgagggaagagtctggagtggtattggcgtantcagtcattcgngtacttcgaccgtntactcgcagctcgtggtaggacgggccctattccgacctatttcccgaaggggaccgaccggtcccgacgtaacctcgtaactttactcgtgctaaagactgtaaccttaggttcctaggaacgaaccccgaagaccgaacggactaatacgtacttaactgtcgcgacggtaaggtacttaacgttcggaccgttccggtaaccgggggtaccccggtaaccgtcggtaccgaccgttccgcccgaccg

SEQ ID NO: 303904 - DNA, 679 bp, Homo sapiens
  misc_feature: GZ8MTXP02GW3QA.45.5.A05.1.454.CMB.2.raw
  modified_base (358)..(358): a, c, t, g, unknown or other
  misc_feature (358)..(358): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggtatttagtacggactattgcggtgacccagactccactctccctgtcccgtccaccccgtgggcaggtccggccgccatcctcctgcctacgtctagtcggagtccttacttacataacaaagtggaaagtactttattgtactggtacctgacaggacggccaggccagtccgccgcacgcctccgtagtccagcacgggtccttaccgacgtcccggttccgnggtatccgtacagtacaggttcaggtacgacgacggtatcgaagtactactacttcctttacacgttactaagaaaacttcgaacgtccggtagtcgaccgtagtaggacggttattgggtttagttacgttttacgttagtcgtacgtagtacgtaacgtagtacgttacgggtaaccggtaacccggttaacggttaccgggtttaccgggggaacccgggggtacgtaacgggggcggttaacgggggtaacgttaccgtaaaacggtaaccggttaaggttcggtacgtccgggtactaacccggttacttaaccgg

SEQ ID NO: 303905 - DNA, 591 bp, Homo sapiens
  misc_feature: GZ8MTXP02J0SPL.45.5.A05.1.454.CMB.2.raw
  modified_base (376)..(376): a, c, t, g, unknown or other
  misc_feature (376)..(376): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtccacccctgggcagtcggccgccatctcctgcacgtctagtcggagcctcttacataacaaatggaaagtacttatttgtactggtacctgcaggaggccaggccagtccgccgcagctcctagtccagcaggtccttcccgacggtcccggttccctgggtagtgtacaacggtacaggttcaggtggaccacgggntcagacactattctttcactactagaaaactcgaacgccgtagcggccgcgtaggagtagttgtttggttgtttacgttacgtgactagtcgacgtaagtacgtacggtacggtaccggtacgtaccggttcggggacccgggggtacgagggtcgtacgggtacggtacgaacgtaccgaacgtggtacggcgtcggacctactacgtcgttcg

SEQ ID NO: 303906 - DNA, 556 bp, Homo sapiens
  misc_feature: GZ8MTXP02FPG13.45.5.A05.1.454.CMB.2.raw
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (492)..(492): a, c, t, g, unknown or other
  misc_feature (492)..(492): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgttaggtctggattcgtcttcngcgactactacctgagttggtccgctggctcgaggganagtcgtggagtggattgcgtacatcagtcattctgacttcgaccgtctactacgcagtctcgtggtgggacggccgtatcacctattccgagggacgacgcccgacgaactcctaactttactctagcaggatcgtactagtcgtagacgacccgaagacgacgacagtatatactagngcggacgaggtacgttacgtggccgtcggtcggggaccccggacctcggtccaccgtctccgcg

SEQ ID NO: 303907 - DNA, 511 bp, Homo sapiens
  misc_feature: GZ8MTXP02F8MEZ.45.5.A05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (392)..(392): a, c, t, g, unknown or other
  misc_feature (392)..(392): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccnccatctcctgcacgtctagtcggancctcttacatacaaatggaaaagtacttatttgactggtacctgcagngccaggccagtcgccgnagctcctagtccagcaggcttccagtccgttcctggatgtcagacaggttcaggtgacaggatcaagacacatctttcactctagaaaatcagccgtgtgccgntgaggatggttaggttgtttattactgtacagtgacaagcttagtacgtacgtactacgtttcgggacggggaccgtaggcgtggacgtcaaagtcgaacgtgtacgcgtcacgactac

SEQ ID NO: 303908 - DNA, 655 bp, Homo sapiens
  misc_feature: GZ8MTXP02I4HK2.45.5.A05.1.454.CMB.2.raw
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtgggggaagaacggtcaacccgtgggcgggtcccnggaggctctccttgtttaggttctggtacttcgtcttcagtcgactactacctgtaggttcgggtccggntcggcctccgagggaangtctggagtggattgcgtantcagtctatctgacttccgactctactacgcagctcgtggagggcgggccgtattccacctagttccgacggacgaccgccgacgacctctaactttcactgacagtatacgacgttagtctacggaaccgacccgaacgacgaccggtacctaattaagttaacgttactcggtacggtccggtacggaagggttaacgttttaaccgggtcgggtaccgggtttaccccgggggcgggggtaccccccgggttaacccggttaccggggtacccgttaccccggttccgtccccggtacccgg

SEQ ID NO: 303909 - DNA, 605 bp, Homo sapiens
  misc_feature: GZ8MTXP02GVF62.45.5.A05.1.454.CMB.2.raw
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
tcagacgcgatcgacacgaccggtgctcgatttagatagatagacagggggatcaggacttctcagttcatcttctcaccatgaggctccctgctcagctcctggggctgctaatgctctggatccctggatttagtacggacattgcggtgacccagactccactctccctgtccgtcacccctgggcagtcggccgccatctcctgcacgtctagtcggagcctcttacatacaaatggaaagtacttatttgtactggtacctgcaggaggccaggccagtccgccgnacgcctcctagtccagcaggtcctccgacggtcccggttccctggtagtgtcacgacaggttcaggtcggacacggntcgaagacactattctttacacttactaagtaaaactcgaacggtccggttggtcggacccggtcgtagggaggttagttgggtttacggttagttttaactttacgtgactagttgactaagtcgtagtaacggtaccggtacgtaccggtttcggggaccggggtacgaggtcggtagggacgtacgtaaacgtcggtaacgtggtcggacttcggacctacgtagttcgttacg

SEQ ID NO: 303910 - DNA, 632 bp, Homo sapiens
  misc_feature: GZ8MTXP02GUTXT.45.5.A05.1.454.CMB.2.raw
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttccttgctattattataaaggtgtcctgtgtcaggtacagatggcggagtcgtgggggaagaacggtcaacccgtggcgggtccctgaggctctcctgttaggtctggattcgtcttcagcgactactacctgagttgggccgctggcctaccgagggaagagtcgtggagtggattgcgtacatcagtcattcngtacttcgacctntactacgcagctcnggtggacgggccgtattccacctacgtttcccgacggggacgaccggccgcgtaaacctcctaactttacgtccttgacctaggatgaccttagttacaggacgaacccgaaagaccgaccggacctaataatagttaccgtggtacggacgtaccggtagggtaacgtttaaccgtttcggggcccgttccgggtccgggggacccccgggtaacccgtcggggtaccgaccccgttccgtaccccggtaccg

SEQ ID NO: 303911 - DNA, 548 bp, Homo sapiens
  misc_feature: GZ8MTXP02GLGAC.45.5.A05.1.454.CMB.2.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (427)..(427): a, c, t, g, unknown or other
  misc_feature (427)..(427): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaacccgtggcgggtcctgaggctctcctgtttaggttctggattcgtcttcagcgactactacctgagttgggtccgctggctccgagggagngtcnggagtggnttgcgtacatcagtcattctgacttcgacctctactcgcagctctggtggagggccattccacctattccgaggaccgacgccgacgactctactttanctgcagtatcgactgtctaggacgaccgaagacgacgaccatatattactgtcgcgcgaggtacgttacgtcggcgtccggtcggggcccggtaccgtcggtacctaccggtcctccgccg

SEQ ID NO: 303912 - DNA, 745 bp, Homo sapiens
  misc_feature: GZ8MTXP02HHA0C.45.5.A05.1.454.CMB.2.raw
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattaataaaaggtgtcctgtgtcaggtacagatggcggagtcgtgggggaagaacggtcaaccgtgggcggtccctggaggctctcctgttaggttctggtnttcgtcttcagcgactactactgaggttcggccgntggcctaccgaggganagtcgtggagtggattgcgtacatcagtctattctgtaccttccgaccgtactactacgcagtcgtcgtgggtacggggacgggtccgtattaccaccctacgtttacccgacgggaccgaccggacccggtaaccgtaaaccgttcccttaaccgttttaacgttccgttacgacgtaaacggtacgttacgtaaccgtttaacggttccgttacgggaaaccggaaaaccccggaaacggtaaacccggacccgggtaaccctaaagttaaactttaactttaaaccggttggtaccggtacggtaaccggggtaaggttaaacggttttaaccggttcgggggtacccgggttcccgggtaacccggggggtaccccggtacccggttccgggtaccgtaccccggtccgttcccgacccgg

SEQ ID NO: 303913 - DNA, 535 bp, Homo sapiens
  misc_feature: GZ8MTXP02IP9G1.45.5.A05.1.454.CMB.2.raw
  modified_base (373)..(373): a, c, t, g, unknown or other
  misc_feature (373)..(373): n is a, c, g, or t
  modified_base (486)..(486): a, c, t, g, unknown or other
  misc_feature (486)..(486): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaagaacggtcaacccgtggcgggtccctgagctctctgttagttctgattcgtcttcagcgactactacctgagttgggtccgctggctccgagggagagtcgtggagtggattgcgtacatcagtcatttctgtattccgaccgttctactacgcanctctggtggacgggcctattccacctatttccgacgggacgacgccgacgactcctactttactctgcagatgactagtcgtagacgaccgaagacgacgacatatatactgngcgcgaggtacgttacgtcgcgtcgcgggccgacgtcgcncgtcncgcg

SEQ ID NO: 303914 - DNA, 556 bp, Homo sapiens
  misc_feature: GZ8MTXP02IIMD0.45.5.A05.1.454.CMB.2.raw
  modified_base (333)..(333): a, c, t, g, unknown or other
  misc_feature (333)..(333): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatgggcggagtcgtgggggaagaacggtcaacccgtggcgggtcctgagctctctgttagtctgattcgtcttcagcgactactactgagttcgggccggctggctccgagggagagtctggagtggattgctantcagtcattctgtacttccgacctctactacgcagtctcgtggtcgggacgggcctattcacctacttccgaggacgacgccgacgtactctacttactctgcagatgactagtctagacgaccgagacacgacatatattactgtcgcgacgtaggtacgttacgtcgggtcgtccggtcgggggaccccggaaccgtcggtaccgtaccgtccgtccgccg

SEQ ID NO: 303915 - DNA, 532 bp, Homo sapiens
  misc_feature: GZ8MTXP02FH83M.45.5.A05.1.454.CMB.2.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (468)..(468): a, c, t, g, unknown or other
  misc_feature (468)..(468): n is a, c, g, or t
  modified_base (527)..(527): a, c, t, g, unknown or other
  misc_feature (527)..(527): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaaccctgggcgggtccctggaggctctcctgtttaggtctggattcgcttcagcgactactacctgagttgggccgntggctcagggaangtctggagtggattgcgtacatcagtcattctgacttcgaccgtntactacgcagctcgtggtggagggcctattccacctattccgagggacgacgccgacgaactctacttatctgcagatgactagtctagacgacccgaagacacggccanatatactgtgcgcgaggacgttacgtggcgtcgcggggcccggacctcggccaccgtcnccgcg

SEQ ID NO: 303916 - DNA, 579 bp, Homo sapiens
  misc_feature: GZ8MTXP02I7NEH.45.5.A05.1.454.CMB.2.raw
  modified_base (180)..(180): a, c, t, g, unknown or other
  misc_feature (180)..(180): n is a, c, g, or t
  modified_base (219)..(219): a, c, t, g, unknown or other
  misc_feature (219)..(219): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtntcctgtgtcaggtacagatggcggagtcgtagggggaanaacggtcaacccgtggccgggtcctgaggctctccttgtttaggttctggtattcgtcttcagcgtactactcctgagttgggccgntggctcgagggangtcnggagtggattggcgtacatcagtctattctgacctttcgaccgtctaactcgcagctctggtggacggcctatcactattcgaggacncgccgacgactctacttanctcgcagagtcgaccttagtcgtagaaccgaacccgaagaccgacggtaccaagttataacttacgtgtacgcgacggtagtaacgttaacgtcgggtccgtaccgggcgggggtacccgaaccgtcggcccgaccgtccgtccgaccg

SEQ ID NO: 303917 - DNA, 628 bp, Homo sapiens
  misc_feature: GZ8MTXP02HYS54.45.5.A05.1.454.CMB.2.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
  modified_base (460)..(460): a, c, t, g, unknown or other
  misc_feature (460)..(460): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaacccgtggcggtcctgaggctctctgttagtctggattcgtcttnagcactactactgnggttggccgctggctcgaggagagtcnggagtgtattggcgtantcagtctatctgacttcgacccgtntaccgtacgctaagtccgttctggtcgggacgggggtacctacgttcctaaccctagtttacccgaacggggtaccgaccggcccgacgtaacctccgttaactttanccgtgacaggtatcgtacgttagtcgttaggaccgaaccgaacgaaccgaccggactaatagttaacttacgtgtacgtcggacgtaggttacgttaaacgttcggtccggtccggtaaccgggggaccccggaaccggttcggacccgtaccggtcctcccggaccg

SEQ ID NO: 303918 - DNA, 604 bp, Homo sapiens
  misc_feature: GZ8MTXP02F5N0W.45.5.A05.1.454.CMB.2.raw
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcttgggttttcctgctattattataaaaggtgtcctgtgtcaggtacagatggcggagtcgtgggggaagaacggtcaacccgtgggccgggtccctggacggctctccttggtttaggtctggtacttcgtcttcaggcgactactacctggaggttcgggtccgctggctccgagggagagtcgtggagtggattgcgtacatcagtcattctgacttcgacctctactacgcagctcgtgtgggacggcctatccactacttcgaggacgacgccgacgactctactttatctcgacagatgactagtcgtacgacgaacccgaacgacgacgaccaagtaatattacgtgtcggacggcggaaggtacgtttaacgttcgggtccggttccgggtccgggggtacccccgggtaacccggtcgggtacccgtcccggtaccgtcccgacccgg

SEQ ID NO: 303919 - DNA, 680 bp, Homo sapiens
  misc_feature: GZ8MTXP02FTPE9.45.5.A05.1.454.CMB.2.raw
  modified_base (226)..(226): a, c, t, g, unknown or other
  misc_feature (226)..(226): n is a, c, g, or t
tcagacgcgatcgacacgaccggtgctcgatttagatagatagacaggggactgatcaggacttctcagttcatcttctcaccatgaggctccctgctcagctcctggggctgctaatgctctggatccctggatttagtacggacattgcggtgacccagactccactctccctgtcccgtccacccgtggcagtcggccgccatctcctgcacgtctagtcgancctcttacatacaaatggaaagtacttattgtactggtacctgcagacggccaggccagtccgccgcacgtcctcctagtccagcgacggtccttccgacgtcccggttccctgggacgtcgtacacgacgtacgggtttcacggttcgggaccaacgggataccgaagacctactatttcctttacacgttactaagaaaactcgaacgtccgtaggtcggccgtcgtaggtaggtagtttgggtttagggtttagttttactttaccggtagtaccgtagtacggtacctaagggttacgttacgggtaaaccggtaccccgggttaaaccgttcccggggttttacgggggaccccgggggtaaaccggtacggggtaccggttaggggtaaacggtacgtaaacggtaaccggtaacgttgggtacggtccgtacgaccgtacgttaccg

SEQ ID NO: 303920 - DNA, 599 bp, Homo sapiens
  misc_feature: GZ8MTXP02HCVEB.45.5.A05.1.454.CMB.2.raw
  modified_base (312)..(312): a, c, t, g, unknown or other
  misc_feature (312)..(312): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgttagtctggattcgtcttcagcgactactactggagttggccgctggctcgagggaangtctggagtggattgcgtacatcagtcattctgacttcgacctctactacgcagctctggtggacggggcctaagtttccaacccttatttccgaacgggggtacgaccgcccgacgaaactcctaactttacgctgacagactagactagtctagacgaccgaagaccacggctaagtatacttacgtagtcgcgacgtaaggtacgtttaacgtcggtaccgttccgggtaaccgggggtaccccggtaaccgtccgggttaccgacccggtttccgacccgccg

SEQ ID NO: 303921 - DNA, 621 bp, Homo sapiens
  misc_feature: GZ8MTXP02FH3FG.45.5.A05.1.454.CMB.2.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaaccctggcgggtccctgaggctctctgttagtctggnttcgtcttcagcgactctacctggagttgggtccgctggctcgagggaangtctggagtggattgcgtacatcagtcattctgacttcgaccgtctactacgcagctcgtggtggacgggcctattcacctattccgaggacgacgccgacgtacctctacttactctagctagactagtaacgtagtacgtacggaacgaaccccggaaagaccgaaccgggaccaagttaactaacttacgtcggtacgcggtacggaagggttaacgtttaacgttcggggtaccggttccggaaccggggggtacccccggtaaacccgttcgggtacccgtacccggttccgtacccggtacccg

SEQ ID NO: 303922 - DNA, 624 bp, Homo sapiens
  misc_feature: GZ8MTXP02JCZHZ.45.5.A05.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattatataaaaggtgtcctgtgtcaggtacagatggcggagtcggtgggggaagaacggtcaacccgtggcgggtccctggaggctctcctgtttaggtctggnttcgtcttcagcgactactactgagttcgggtccgcgtggctccgagggangtntggagtggnttgcgtacntcagtcattctgacttcgaccgtctacacgcagtctcgtggtgggacggtccgtattcaacctacttccgacgggacgaccggccgaccgtactcctaactttactctgcatacgtgactagtcgtaggacgaacccgaagaccgaccgggccaatactaagttacctgtacggacggtaccgggaaggtacggtttaacgtcgggtccggttacccggggtccgggggacccccggggtaacccgttccggtacccggtaccccggttccgtccccgggtacccg

SEQ ID NO: 303923 - DNA, 904 bp, Homo sapiens
  misc_feature: GZ8MTXP02JRZRB.45.5.A05.1.454.CMB.2.raw
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtagggggaagaacggtcaacccgtggccgggtccctgaggctctcctgttagttctggtattcgtcttcagcgactactacctgaggttcgggccgngtggctccgagggangtcgtggagtggatgcgtacatcatctattctgtacttaccgaccgttctaccgtacgcgtacgtaccttccgtaggggtacggggtaccggggcccgttaacgtttaccccgtaacccgttaccgtttttaccccgggaaaccgggggtaacccccggtaacccgggaccccccgggggtaacccggttaaaacccccgtttacccttaaacccgtttttacccgttaccggttaccggtacccgtaaagggtaacgtttaaacgggtaacccgtttaacgggtttacccgttaaccggggtaaacccgggtaaaacccccggaaaaccgggtaaacccgggaaacccggggtaacccccttaaaagtttaaacgttttaaacgttaaccggttttacggggttacccgggaaacgggtaccccggggttaaaaggggtttaaaccggttttaaaaccggggtttccgggggtaaccccgggtttccccgggggtaacccgggggtacccccgggggttaaaacccccggtttcgggggtacccccgttaacccggggttccccgttaccccggtacccccgg

SEQ ID NO: 303924 - DNA, 694 bp, Homo sapiens
  misc_feature: GZ8MTXP02GC1IV.45.5.A05.1.454.CMB.2.raw
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (484)..(484): a, c, t, g, unknown or other
  misc_feature (484)..(484): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtagggggaagaacggtcaacccgtgggccgggtccctgacggctctccttggtttaggttctggtattcgtcttcagcgactactacctggtaggttcgggtccggctcggcctaccgagggaagngtcgtggaggtggattgcgtaacntcagtctattctagccttccgaccgttctacgtacgcagtcctgtggtcggacggggtcctattccaccctacgttaccgacggggaccgaccggaccgaccgtaaacctccgtaacttttacncgtacgacagtacgttacgtacgttacgtctacgggaaccgaaaccccgaacgaccgaccggacctaaagttaacgttacttaacgtggtacggaccggtacggtaaagggtacgtttaaaccggttcgggtacccggttacccggggtaaccgggggtaccccggtaaacccggttcggtccccgtacccggtccgttacccggacccg

SEQ ID NO: 303925 - DNA, 559 bp, Homo sapiens
  misc_feature: GZ8MTXP02GZETV.45.5.A05.1.454.CMB.2.raw
  modified_base (331)..(331): a, c, t, g, unknown or other
  misc_feature (331)..(331): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacggtcaacccgtggcgggtcctgaggctctctgtttaggtctggattcgtcttcagcactactacctgagttggccgctggctccgagggagagtctggagtggattgcgtantcagtcattctgacttccgaccgtctactacgcagcctcgtggtgggacgggccgtattccacctacgtttccgacgggacgaccggccgacgaacgtcactttacnctgcagntgactgtctggacgaccgaagacacggcatactattactgtacgcgacggagacgttacgtacggtcgtccggcgggggccccggaaccgtcggtccaccggtcctcggacccg

SEQ ID NO: 303926 - DNA, 543 bp, Homo sapiens
  misc_feature: GZ8MTXP02GSPCG.45.5.A05.1.454.CMB.2.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagacgcgatcgacacgaccggtgctcgatttagatagatagacagggggagctctggggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggtctggattcgtcttcagcgactactacctgagttggtccgctggctccgagggaangtctggagtggattgcgtacntcagtcattctgattcgaccgtntactacgcagctctgtggagggccattccaccatttccaggacgacgcgcgaactcactttatctagcagatgactagtctacgagaccccgaagacacggtaccatatatactgtgcgcgaggagttaaacttggccgtccgtgggggtccccggaacccgtcggtcgaccggtcctcgccg

SEQ ID NO: 303927 - DNA, 582 bp, Homo sapiens
  misc_feature: GZ8MTXP02GPQNC.45.5.A05.1.454.CMB.2.raw
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatgggcggagtcgtgggggaagaacggtcaacccgtggcgggtccctgaggctctctgtttaggtctggattcgtcttcagcgactactactgagttgggccgctggctccgagggangtcnggagtggattgcgtacatcagtcattctgacttcgaccgtctactcgcagctcgtggtgggacgggtccgatttccgacctagttccgaggggtaccgacgccgacgtaactctacttanctcgcagntgactgtctgaacgacccgaagacacggaccagtatattacgtgtcgcgcggtaggtacgttaacgtcgggtccgttacccgggtcgggggacccccggtaccgttacggtcccgtaccggttccgtccgacccgg

SEQ ID NO: 303928 - DNA, 488 bp, Homo sapiens
  misc_feature: GZ8MTXP02FIQZ7.45.5.A05.1.454.CMB.2.raw
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggagtgtcagacaggttcagtggacacggatcagacacatctttcactctgaaaatcagccgtgtggccgctgagatgttggtgtttattactgcatgcaagctgtagaccgtacactttgggccgggggtaccaggctggagtcaatcgaactgtggctgcacatctgtcttcatctccgcatctgatcgatcgcgtctgagcggctggcaacggcgcanagn

SEQ ID NO: 303929 - DNA, 637 bp, Homo sapiens
  misc_feature: GZ8MTXP02JRX0L.45.5.A05.1.454.CMB.2.raw
  modified_base (220)..(220): a, c, t, g, unknown or other
  misc_feature (220)..(220): n is a, c, g, or t
  modified_base (286)..(286): a, c, t, g, unknown or other
  misc_feature (286)..(286): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggtatttagtacggacattgcggtgacccagactccactctcctgtccgtcacccgtgggcagtcgccgcatctcctgcacgtctagtcgancctattacatacaaatggaaatcttattgtactggtactgcaggacgccaggtccagtccgccganacgtcctcgtaagccaggtcacggtccttccgacggtcccggttacctgggacgtcgtacaagtactgggtttaccaggtacgggacctacggatccaagactactacttcgtacactatagaaaatcgacgtcgttggcggaccgtgtaggtacggttagtttggtttaggttactttttaacgacgttcgaacgtagtaggtaacctaaggtccgttaaggttaaccgggtacccggttaccgtaaccggggtttccggggaaccgggggtaccgtaaaggggtccgttaagggaacggtttcaaaacgttcgggtaaccgttggtacggctacggaccttaacttcgg

SEQ ID NO: 303930 - DNA, 675 bp, Homo sapiens
  misc_feature: GZ8MTXP02GC6TS.45.5.A05.1.454.CMB.2.raw
  modified_base (262)..(262): a, c, t, g, unknown or other
  misc_feature (262)..(262): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccgtggcggtcctgagctctcgtgttaggtctggtnttcgtcttcagcgactactaccgtgtacggttgggccggtctggcctccgaggggaanggttcgnggagtggattcggctacatcgagtctattcctgtaccttcgaccgtctactacgacagtctcgtggtcgggacggccgtatcgacctagttaccgagggacgaccgccgaccgaactcctactttacgtctagctaagtactagacttagtacctaggaccgaaaccccggaagacccggaaccggaaccctaattaactttaaacgtttaaccgtggttacggacggtacgggtaaacggggttaacgtttaaccgggtcgggtaccggttcccggggtaaccgggggtacccccggggttaaccggttccggtacccgtacccggttacccttcccgggaaccccg

SEQ ID NO: 303931 - DNA, 785 bp, Homo sapiens
  misc_feature: GZ8MTXP02J2YW9.45.5.A05.1.454.CMB.2.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttggctgagctgggttttcctgctattatataaaggtgtcctgtgtcaggtacngatggcgagtcgtagggggaagacggtccaaccgtgggccggtccnggcgtctctccgttgttaggttctggtattcgtcttcgagccgtactacctaccgtggtaggtttcggggcccgtcgtcggtcctaccggaaggggtaacgtggtccgtaggggaggtgggtattcggaccgttacacgttcgtacggttcctaagtttccgtaggtaaccccgttcccgtaaccgttacccgttaaaccgttacggacccgtaacgtaccgttccggttaggggtaccgggggtaccggggtacccctagtttacccgtaacccgtaacgtttacccgggagggtaacccggaccggtaccccgaaccgtaacccgttaccgtaaccttttaccgtaccgtacgtaacgtacggtaactacgtaaacgttcgtaacgtacgggaaccgaaacccgaacggaccgaccggtacctaagttagtaacgttaccgttggtacgaccggtaggtaacggttacgttaccgtcgggtacccggttaccggcccgggggtacccggtaacccgtccggtaccgtacccggtcctacggacccg

SEQ ID NO: 303932 - DNA, 794 bp, Homo sapiens
  misc_feature: GZ8MTXP02I8S5Q.45.5.A05.1.454.CMB.2.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagcgttgggttttccttgctattattataaaaggtgtcctgtgtcaggtacagatggcggagtcgtagggggaagaacggtcaacccgtggccgggtcctgaggctctcttgttagtctgtnttcgtcttcngcgactactactggtaggttcgggtccgcgtggcctaccgagggaagagtcgtaggagtggtattggcgtacatcgtagtctattcgtagtacgttcccgaccgttacttaacccgtacgaccgaacgtaccgttcgtcggggttacgggggaccgggggtcccgttaactttacccgtaaacccgttaaccgttttacccggaaacgggggtacccggtaaccccggtaccccgggaacccgttaaaaccttccccgtttaaacttttaacgtccgttacgaccgtaagtagttacgtaaccgtttagttaccgtacgggaaaccggaaccccggaaacggacccggtaacccgggtaaccctaagttacttaacgtttaccgtagggtacggacccgggtacgggtaaagggttaacgttttaaccggttacgggtccccgttaccgggggtccgggggtacccccgggtaacccggtcgggtaccccgtacccggtcccgtacccgtaccccgg

SEQ ID NO: 303933 - DNA, 591 bp, Homo sapiens
  misc_feature: GZ8MTXP02JQQ47.45.5.A05.1.454.CMB.2.raw
  modified_base (164)..(164): a, c, t, g, unknown or other
  misc_feature (164)..(164): n is a, c, g, or t
  modified_base (227)..(227): a, c, t, g, unknown or other
  misc_feature (227)..(227): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
tcagacgcgatcgacacgaccggtgctcgatttagatagatagacagggagagtggagtctggatccctggatttagtacggacattgcggtgacccagactccactctccctgtccgtcacccctgggcagtcggccgccatctcctgcacgtctagtcggancctcttacatacaaatggaaatcttattgtactggtacctgcagaggccaggccagtcgccgnagctcctagtccagcaggtccttccgacggtcccggttccctgggagtgtcagacaggttcagtggacacggatcgagacactatctttcactctaagaaaatcacgcgtagtcggccgctggaggtatggttggttagtttacttacgtgtactatgacaagtcgtaggtacggaccgtacgtaccggtttcggggaccggggtacgaggtacgtacgggagttacgaacgtacgaacgtggtacggtctcggacctacgtacgttctcgtacttacgtacttcccgttacccgctacgtctacggactcgtacgtcgtcgtacgtacgtcggtcggcgtcggacgacggccgactacgngng

SEQ ID NO: 303934 - DNA, 676 bp, Homo sapiens
  misc_feature: GZ8MTXP02GUOC5.45.5.A05.1.454.CMB.2.raw
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (272)..(273): a, c, t, g, unknown or other
  misc_feature (272)..(273): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagacgcgatcgacacgaccggtgctcgatttagatagatagacaggggagctctgggagaagagccccagccccagaattcccaggagtttccactcggtgatcagcactgaacacactaggactcaccatggagtttgggctgagtctgggttttccttgctattattataaaaggtntcctgtgtcaggtacagatggcggagtcgtgggggaanaacggtcaacccgtggcgggtcctgaggctctctgttagtctgtntcgtcttnncgactacactgagttcggcgcnggctcgagganagtctggngtggatgctacatcagtcattctagaccttcgaccgttctactacgcacgcgtctggtcgggacggggtccctagttaccacccgtacgtttcccgaacggggaccgtaccggacccggacccgtaacttacccgtaaccgttttatccttcggaccgtaaaggtattacggtaacttacgttacgtacgtaccggaaacccgtaacggaccgaaccggtaccaacgttattaacgttactacggtcgaccgggacggtaaagggttacggtttaaccgttcggggtcccggttacccgggtaacgggggtacccccggtaccggttacgggtccccgaccggttacccgttaccggacccg

SEQ ID NO: 303935 - DNA, 570 bp, Homo sapiens
  misc_feature: GZ8MTXP02HP36T.45.5.A05.1.454.CMB.2.raw
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (500)..(500): a, c, t, g, unknown or other
  misc_feature (500)..(500): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtcctggaggctctcctgtttaggttctggattcgtcttcagcgactactacctgagttgggccgctggctccgagggaanagtcgtggagtggatttggcgtacntcaagtcattctgactcgacctctactagcagcctntggtgggacgggtccattacaccctatttccgagggaccgacgcccgacgaactctactttactctgacagtatagtacttagtctagacgaaccgaagacgacgacatatatactcgtgngcgaggtacgttacgtcggtccgtccggtcggggcccggtaaccgtcggtaccgaccggtcctccgaccg

SEQ ID NO: 303936 - DNA, 543 bp, Homo sapiens
  misc_feature: GZ8MTXP02JQDHB.45.5.A05.1.454.CMB.2.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
tcagacgcgatcgacacgaccggtgctcgatttagatagatagacagggaagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaanaacggtcaacccgtggccgggtcctgaggctctcctgttaggtctggattcgtctcagcgactactacctgagttggccgctggctccgagggangtcgtggagtggattgcgtantcagtcattctgacttcgaccgtctactcgcagtctcnggtgggaggcctagttccacctagttccgaggacgccgccgcgactcgtacttatcgtgcagntgactagtctagacgaccgagacgcgcatagtatcgtcgngcgcgaggtacgttacgtcggtacgtccggtcggggacccggtacgtcggtcctaccggtcctccgccg

SEQ ID NO: 303937 - DNA, 648 bp, Homo sapiens
  misc_feature: GZ8MTXP02I0AEQ.45.5.A05.1.454.CMB.2.raw
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggccggtccctggaggctctcctgtttaggttctggtattcgtcttcagcgactactacctgtaggttgggtccgctggcctccgagggaagacgtcgtggagtggattgacgtacagtcagttctattctgtacttcgaccgtctactacgcagctntggtggacgccgattcactacgttccgagggaccacgccgacgaactccgtaactttcnctcgcgagagtcgaacttgtactagaaccgaaccccgaagaccgaccggtaacctattaagtacttttaacggtcggtacggtaccggtacgggttaaaggttaaccggtttacggttccgggtcccgggttaccggggtaacccgggggtaacccccgggtaccgtcggtaccccgtacccggttaccgaccccggtac

SEQ ID NO: 303938 - DNA, 650 bp, Homo sapiens
  misc_feature: GZ8MTXP02JNQHP.45.5.A05.1.454.CMB.2.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttccttgctattattaataaaaggtgtcctgtgtcaggtacagatggcggagtcgtgggggaagaacggtcaacccgtggcggtcctgagctctctgttagtctggattcgtctcagcgactactactgaggttcggtccgntggctccgaggagngtcgtggagtgattgcgtacatcagtcattcgtgtacttccgaccgtctacgtacgacagtcctcgtggtcgggacgccgtattccacctacgttccgaacggggacncggccgaccgtaactccgtaactttacnctacgcgaagtcgtacgacttacgtcgtagggaaaccgaaccccgaaaggacccgtaccggacctaagttattactacgtgtacgacggtacgaaaggggttacgtttaacggttcgggtacccgttaccggggtccgggggtaccccccgggtaaaccgttcggggtaaccccgtacccggtttcccgtaacccggtccccgg

SEQ ID NO: 303939 - DNA, 815 bp, Homo sapiens
  misc_feature: GZ8MTXP02FQ3FM.45.5.A05.1.454.CMB.2.raw
  modified_base (178)..(178): a, c, t, g, unknown or other
  misc_feature (178)..(178): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtntcctgtgtcaggtacagatggcggagtcggtgggggaagaacggtcaaccgtggcgggtccctgaggctctcgttgtttaggttcgtggtattcgtctttcagccgtactactacctaggtggttcgggtccggcgtggccgtaccgtaggggaacgaggttcgtaggggnggttaggagtttacggacggttacacttcgacgttactntttacgttagtccgtttaccggtaccgttacgttaccgttaacgcttaacgggacccgttggtggggtttacggggaccgggggtaccttaacgtttaccaacccttacgttttaccccgggaaaggggtaccggaccggtacccggtaaccgtaaaccctcccgtttaacgttttaactcgttacggacctaagtaaccgtggtaaacttccggttagttacgggtaaccggaaacccgaaaccggaacgaccgggttaaccctaaggtttaaaccttaaaagttccggtttaacgtaccgggtacggtaaccgggaaaggggtttacgtttaaaacggtttcggggtcccggttaccggggtaacccgggggtacccccggggtaaccggttccggtacccggtaccgtcccgtacccggacccg

SEQ ID NO: 303940 - DNA, 540 bp, Homo sapiens
  misc_feature: GZ8MTXP01D2H81.44.2.A02.1.454.CMB.2.raw
  modified_base (388)..(388): a, c, t, g, unknown or other
  misc_feature (388)..(388): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagaattacttggttggtatcaacagaaggcaggacagcctctaggtcctcatttacggacatccaggcgggcatccgggggtcctgaccgattccagcgccagcggtctgggcagacttcgcactcacatcaacgctgcaggtnaagatctgcaacttattactgtcagtctaagtatttagaaacggtccccttacgaaccgttttcgggccggggggtaccctaggggtcgggaaactcgaaggacgaaacgtggtgggccttggcaaccatctgtcttctaattccttccccg

SEQ ID NO: 303941 - DNA, 517 bp, Homo sapiens
  misc_feature: GZ8MTXP01BSC1B.44.2.A02.1.454.CMB.2.raw
  modified_base (498)..(498): a, c, t, g, unknown or other
  misc_feature (498)..(498): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttgtatcaacagaaggcaggacagcctcctaggttcctcatttacgggacatccaggcgggcagtccgggggtcctgaccgattccagcgccagcgggtctgggcagacttcgcactcacatcaacggcctgcagggtgaagatcttgactaacttatactgtcagctagttatttgaaacggcccctcacgtttcgggcgggggaccgagggtgaactcgagacgacgtgtgcgttgcaacntctgtcttctcttctcccg

SEQ ID NO: 303942 - DNA, 560 bp, Homo sapiens
  misc_feature: GZ8MTXP01C7MJI.44.2.A02.1.454.CMB.2.raw
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattactggttggtatcaacagaaggcaggacagcctctaggttcctcatttacgggacatccgaggcgggcagtccgggggtccctgaccgattccagcgccgagcggtctgggcagacttcgcactcacatcacgctgcnggtnaagntctgactaacttattactgtcgagtcgtagttatttagaaacggtcccctctacgtttcgggcgggggtacccgaggggtcggaactcgacggtaacgaacgtaggtcggcgttcggactaacccgattccgtcggttcctttactaacttcccgtttaaccccg

SEQ ID NO: 303943 - DNA, 530 bp, Homo sapiens
  misc_feature: GZ8MTXP01A3QV0.44.2.A02.1.454.CMB.2.raw
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaacctggatacaggtccaacgttgagaattacttggttggtatcaacagaaggcaggacagcctctaggtcctnatttacggacatccaggcgggcagtccggggtcctgaccgnttccagcgccgagcgggtctgggcagactttgcactcacatccaacgcctgcgagggtgaagatcttagctaacttataactgtcgaggctagtactttagaaacgtcccctcgtacgtttcgggcgggggaccgtaggggtgaactcgagacgaacgtggtggcttggcaaccntcgtntcttctaacttctcccg

SEQ ID NO: 303944 - DNA, 641 bp, Homo sapiens
  misc_feature: GZ8MTXP01AHU7Y.44.2.A02.1.454.CMB.2.raw
  modified_base (310)..(310): a, c, t, g, unknown or other
  misc_feature (310)..(310): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgcaagtccagccaacaaccttggaactacgaggtaccaacgttgaagtaatttacgttggttggtatcaaacgagaaggcaggacagcctcgtaggttcctanagtttaccgggacacgtccgagggcgggcacggtcccggggtccctggaccgattccgacgcgccgaggccgggtcgtgggcagtacctcgcacgtcaccataccgaacgcctagcgagggtagaagtatcgtagacctaacttacttacgtacgtacgtagtacgtaagttacgtttaacgaaccggtccccgttacgtacccgggtttccggggaccggggggtaccgtacggggtacggtaaccgtcggaacggtaacgaaccgttggtacggcgttcggacctaacccgtagtccgttacgttccttctaacttcccgttaaccccg

SEQ ID NO: 303945 - DNA, 568 bp, Homo sapiens
  misc_feature: GZ8MTXP01EWE5Z.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccaccatccacctgcaagtccagccacacttggatacaggtccaacgttgagtaattacttggttgtatcaacgagaagcaggacagcctccgtaggttcctctagtttacgggacagtccgaggcgggcacgtcccggggtccctgaccgattccgaggcgccgaggccggggtctggggaacagtaccgttcgcacctcaccatccgaacggcctgcgagggtgaagattctagactaacttattactgtacgtagttagttatttacgaaacggtcccctgtaccgtttcgggcgggggtacctaggggtcgaacgtcgaacgacggtaacgttggtggcttgccacgtaatctgtctcacttccttcccgc

SEQ ID NO: 303946 - DNA, 538 bp, Homo sapiens
  misc_feature: GZ8MTXP01DKFD5.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggtttggtatcaaacagaaggcaggacagcctcctaggttcctcatttacgggacatccaggcgggcagtccgggggtccctgaccgattccagcgccgagcgggtctgggcagacttcgcactcacatcaacgcctgcaggtagaagatcttgctaacttattactgtcagtctaagttatttagaaaggtcccctgtaaccgtttcgggcgggggtaccaggggtggaactcgagacgaacgtggtgcgttcgcaacgatctgtcttctaacttcgttccccg

SEQ ID NO: 303947 - DNA, 544 bp, Homo sapiens
  misc_feature: GZ8MTXP01AEV95.44.2.A02.1.454.CMB.2.raw
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaagttgagaattactggttgtatcaanagaagcaggacagcctcctaggttcctcattacgganatccgaggcggcagtcccgggtcctgaccgattccagcgccagcgggtctgggcagacttcgctactcaccatccaacggcctgcgagggtgaacgatctgactaacttatactagtcagtctagttagtttacgaaacgtcccctacgtacgtttcgggcgggggaccgtaggggtcggaactcgaggacggaacgtggtacggcgttgaccaacctactctcgtcttactaacttccgtcccg

SEQ ID NO: 303948 - DNA, 573 bp, Homo sapiens
  misc_feature: GZ8MTXP01EOUOQ.44.2.A02.1.454.CMB.2.raw
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgcaagtccagccacaaccttgatacagtccaagttgataattacttggttgancaacagagcaggacagcctctagtcctcattacggacatccgaggcggcacgtccggggtcctgaccgatcccgagcgcgagcgggtcngggcagtacttcgcactcacatcaacgccngcgaggtgaagattctagactaacttatacgtgtacagtctaagttactttacgaaaccggtccccttagtaaccggtttcgggggaccgggggtaaccgtaggggtacggaactacgaacggaacgttaaacgtgggttcggcttcgaccgtaactctcgttcggtccttacgtaacgtttcccgtaaccccg

SEQ ID NO: 303949 - DNA, 614 bp, Homo sapiens
  misc_feature: GZ8MTXP01C68XU.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaacttggatacaggtccaacgttgagtaattacttggttgtatcaacagaaggcaggacagcctcctaggttcctcattacggacagtccgaggcgggcacgtcccgggggtccctgaccgtattccgacggcgccgaggtccgggtacgtggggcagtaccttcgacacctcaaccataccaacggcctgcgagggtagaagatctagactaaacttattactgtacgagtcgtaagttacgtttacgaaacggtcccctacgtaccggtttcggggtaccggggggtaccgtacggggtcggtaacgtcgacggtaaacgaccgtaggtcggaccgttcggaccctaacctaacgtccgttacgtcctttacctaaccttcccgttaacccccg

SEQ ID NO: 303950 - DNA, 554 bp, Homo sapiens
  misc_feature: GZ8MTXP01DHY84.44.2.A02.1.454.CMB.2.raw
  modified_base (406)..(406): a, c, t, g, unknown or other
  misc_feature (406)..(406): n is a, c, g, or t
  modified_base (481)..(481): a, c, t, g, unknown or other
  misc_feature (481)..(481): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgaccccagtccccagactccctggctgtgtctctgggcgagaggccaccatcacctgcaagtccagccacaccttggatacaggtccaacgttgagaattacttggttggtatcaacagaaggcaggacagcctcctaggttcctcatttacgggacatccaggcgggcagtccgggggtcccctgaccgacttccacggtcgccgagccgggtctgggcagacttcgcactcacatcaacgctgcgaggtcgaagntcttgacaacttattaactgtcagctagttatttagaaacggtcccttacgtacgtttcggggccgggggtacgnggggtcggaaacttcgacgtacggaaacgtggtggacgttggccaacgatctgtcttctaattccgttccccg

SEQ ID NO: 303951 - DNA, 540 bp, Homo sapiens
  misc_feature: GZ8MTXP01A0V19.44.2.A02.1.454.CMB.2.raw
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagagggccaccatcacctgcaagtccagccacaccttgatacagtccaacgttgagtaattacttggttgtatcaaacagaaggcaggacagcctctaggttcctgtagttacggacatccgaggcggcagtcccgggtcccngaccgattccgagcgcaggcggtacngggcagacttcgcactcgacatcaacgcctgcgagggtnaaagntcttgactaacgttattactgtacagtcgtaagttagtttagaaacgtccctcgtacgtttcgggcgggggaccgtagggtggaactcgagacgacgtggtcgcgttgcaactatcgtcgtcttctcttcccgttcccg

SEQ ID NO: 303952 - DNA, 570 bp, Homo sapiens
  misc_feature: GZ8MTXP01ESA48.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagtaattacttggtttggtatcaacagaaggcaggacagcctctaggttcctcagtttacggacatccgaggccgggcacgtcccgggggtccctggaccgtattccgagcgccgaggccgggtactgggaacagtacttcgcactcaccatcaacgctgcagggtgaagatctgactaacttattactgtacgagtctagttatttacgaaacgtcccctacgtacgtttcgggcgggggacctaggggtacggaacgtcgaggtacgaacgtgtaggccgttgcctaaccgatcgtacgtccttcgtaacttccgttaaccccg

SEQ ID NO: 303953 - DNA, 635 bp, Homo sapiens
  misc_feature: GZ8MTXP01DRPTW.44.2.A02.1.454.CMB.2.raw
  modified_base (436)..(436): a, c, t, g, unknown or other
  misc_feature (436)..(436): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggactacaggtaccaacgttgagtaattacgttggttggtatcaacagaaggcaggacagcctcctaggttcctctagtttacgggacagtccgaggccgggcacggtcccgggggtccctggaccgtacttcccgacggtcgcccgaggccgggtacgtgggaacagtacttcgacaccgtcacatcgaacggcctgcgagggtgaaagntctcgactaacttattactgtacgtagtactagttactttaggaaccgtccctacgtacggtttccgggcgggggtaccgtagggtcggtaaccgtcgaggtaaccggttaaacgttgggtcggttaccgttcggttaccgtaacccgtaagttccgtttcggtcccgttttccttaacccgtttttccccgtaacccg

SEQ ID NO: 303954 - DNA, 567 bp, Homo sapiens
  misc_feature: GZ8MTXP01ANVWZ.44.2.A02.1.454.CMB.2.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagaggccaccatcacctgcaagtccagccacaaccttggatacaggtccaacgttgagtaattacgttggttgtatcaacagaaggcaggacagcctctaggttcctcagtttacggacatccgaggccgggcacgtcccggggtccngaccgnttccagcgcgaggcggtctgggcagacttcgcactcacctatcaacgtcctgcgagggtgaagatctagactaacttattactgtacgagtactagttactttacgaaaccgtcccctcgtaccggtttcggggccgggggtacgaggggtgaacgtcgaacggacgaacgtggtcggttacgttgaccaaccgtatccgtgtccttctaacgttccctccccg

SEQ ID NO: 303955 - DNA, 611 bp, Homo sapiens
  misc_feature: GZ8MTXP01C9I2L.44.2.A02.1.454.CMB.2.raw
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (580)..(580): a, c, t, g, unknown or other
  misc_feature (580)..(580): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctctgggcgagacgggccaccatcacctgcaagtccagccacaccttggatacaggtccaacgttgagtattacgttggttgtancaacagaggcagacngcctcgtaggtcctactagttacggacagtccgaggccgggcacggtcccggggtccctgaccgtattccccgagccgccgaggtccgggtacgtagggaacacgtacctccgacacctcaacctctaccgaacggcctaggacgagggtagaagtcttacgtacgacttaaacttacttacgttgtacgagtcgtaagttacgtttaggaacccgtcccgtagtaccgggttcggggaccgggggtacgtagggtcggaactcggaacgtacgacgtgggtcgcgttcggttccaacgtntcgttcgtcttacgtcttcccgttaaccccg

SEQ ID NO: 303956 - DNA, 577 bp, Homo sapiens
  misc_feature: GZ8MTXP01AQA9L.44.2.A02.1.454.CMB.2.raw
  modified_base (296)..(296): a, c, t, g, unknown or other
  misc_feature (296)..(296): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagacggccaccatcacctgcaagtccagccacaaccttggatacaggtccaacgttgagaattacttggttgtatcaaacagaagcaggacagcctcctaggttcctnagtttacggacagtccaggcgggcacgtcccgggggtcctggaccgattccgagcgccaggccggggtactcggggaacaggtacctttggcctacgtacaccatccaacggcctgacgagggtgaaagattctgactaacttatactgtcagtctagttacgtttacgaaacgtcccctacgtaccgtttcggggccgggggtacctaggggtcggaactcgaggacgaaacgtggtacggcgttggccaacgatctgtcttcgtaacttccgttccccg

SEQ ID NO: 303957 - DNA, 566 bp, Homo sapiens
  misc_feature: GZ8MTXP01BKR66.44.2.A02.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatccacctgcaagtccagccacaaccttggatacaggtccaagttgagtaattcttggttgtatcaanagaaggcaggacagcctctaggtcctcagttacgganatccgaggcggcacgtcccgggtccngaccgtatcccgagcgccgaggccgggtcngggaacagaccttcgcacgtcacatcgacgctgcgagggtagaagactctagactaacttattactgtacgagtactagttagtttagaaacgtccctagtacgttccggggcgggggtaccgtaggggtcggtaactcgaggacgaacgtggtcggcgttcggcctaacctagttctcgttccttactaacttccccgttcccg

SEQ ID NO: 303958 - DNA, 585 bp, Homo sapiens
  misc_feature: GZ8MTXP01ASA2M.44.2.A02.1.454.CMB.2.raw
  modified_base (417)..(417): a, c, t, g, unknown or other
  misc_feature (417)..(417): n is a, c, g, or t
tcagacagtatatacacgaccggtgctcgatttagactcatctacagggggccacaacaggcaggcaggggcagcaagatggcgctgcagacctaggtcttcatttctctgttgctctggatctctggagcctacggggacatcgtgctgacccagtccccagactccctggctgtgtctcgtgggcgagagggccaccatcacctgcaagtccagccacaaccttggatacaggtccaacgttgagtaattacgttggttgtatcaacagaaggcaggacagcctcctaggttcctcagtttacgggacatccgaggccgggcacgtccgggggtccctgaccgtattccgagcgccgaggcgggtctgggaacagaccttcgctactcaccatccaacggcctgcgaggtgaagntcgtagactaacttattactgtcgagtctagttactttagaaacgtccccttagtacgtttcggggcgggggtacgtacggggtggaacgtcgagggtaaccgaacgtggtacgggcgttcggccaacccgtattccgttacgtccttactaacgttcccgttccccg

SEQ ID NO: 303959 - DNA, 547 bp, Homo sapiens
  misc_feature: GZ8MTXP01DUNO7.44.2.A02.1.454.CMB.2.raw
  modified_base (395)..(395): a, c, t, g, unknown or other
  misc_feature (395)..(395): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacacctggatacaggtccaacgttgagtaattacttggttgtatcaacagaaggcaggacagcctcctaggtcctcatttacggacatccgaggcgggcacgtcccgggtcctaggaccgattccgacgcgccgaggcggtctgggcagacttcgcactcacatcacgctgcaggtanaagtatcttagactaaacttattaactgtacgagtctaagtttatttacgaaacgtccctacgtacgtttccgggcgggggacgtagggtggaactcgaggacgacgtggtggcttcgacaacgtatcgtcgtcttctaacttccgtccccg

SEQ ID NO: 303960 - DNA, 632 bp, Homo sapiens
  misc_feature: GZ8MTXP01BYIR5.44.2.A02.1.454.CMB.2.raw
  modified_base (268)..(268): a, c, t, g, unknown or other
  misc_feature (268)..(268): n is a, c, g, or t
  modified_base (402)..(402): a, c, t, g, unknown or other
  misc_feature (402)..(402): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgcaagtccagccacaaccttggatacaggtccaacgttgagtattacttggttgatcaaanagaagcagacagcctctaggttccatagttacgggacagtccgaggcggcacgtccgggtccctgaccgattccagcgaccagcgggtcacgggcagtacttcgccacgtcacatccaacgctagcgagggtanaaacgtattcgtagactaaacttacttaacttcgtacgtacgtacgttaagtttaacgttttacggaaaacccgtccccgttaacgttacccggtttaccggggaccggggggtaccgtacgggggttacggaaaccgttcggaaacggtaaccgaaacgttcggtacggttacccgttcggacctaaccgacttccgttcgtcgttacctaactttcccgttaaccccg

SEQ ID NO: 303961 - DNA, 531 bp, Homo sapiens
  misc_feature: GZ8MTXP01CWQWH.44.2.A02.1.454.CMB.2.raw
  modified_base (391)..(392): a, c, t, g, unknown or other
  misc_feature (391)..(392): n is a, c, g, or t
  modified_base (455)..(455): a, c, t, g, unknown or other
  misc_feature (455)..(455): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaacctggatacagtccaacgttgagaattacttggttgtatcaacagaaggcaggacagcctcctaggttccctctagtttaccgggacactccgagggccgggcacgtcccgggggtccctggaccgtattcccgagcgccaggccgggtctgggcagactcgcactcacnncacgctgcaggtgagatctgacaacttattactgtacgagtctagttatttagaacgtccctntaccgttcgggcggggcagggtggaactcgagacgacgtgngcgngcncctatctgtcttntaacgttcgtccccg

SEQ ID NO: 303962 - DNA, 619 bp, Homo sapiens
  misc_feature: GZ8MTXP01EZFGC.44.2.A02.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (397)..(397): a, c, t, g, unknown or other
  misc_feature (397)..(397): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccaccatcacctgcaagtccagccacactggatacgaggtccaacgttgagaattctggttgatcaanagaagnaggcagcctctagtcctnagttacggcatcgaggcgcagtccggggtcctgaccgatccgagcgcccgaggccgggtcngggaacagtacttcgcactcacatccgaacggcctgacgagggtcgaaagnttctagacttaaacctttatacgtgttaccgagtcctaaggtttaactttaggaaacccgtcccccgttacgtaaccgggtttcgggggacccggggggtaaccgtaagggggtacggtaaacgttccggaacggaaaccgggttaaacgtcggggttcgaccgttacggaccctaaccggtattcgtccgggtttcttacgtaaccgtttcccttccccgg

SEQ ID NO: 303963 - DNA, 781 bp, Homo sapiens
  misc_feature: GZ8MTXP01BJNVC.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccagtccccagacctccctggctgtgtctcgtgggcgagacggccaccatcacctgcaagtccagccaacaaccttggatacgaggtccaacgttgagtaattacgttggttgatacaacaggaaggcaggacacgcctaccgtaggttccctacgtagtttaccgggactacgtcccgaggggcccgggactacggttcccgggggtcccctaggacccgtattcccgacggcggtaccgagggtccggggtacgtcggggaacctacggtaaccgtttcccggactaacccgttccgaaacccgtaacgttacccgaaacccgggtcccgttacgggaccggtaaggggttaacggaaacgttaacgtttccgtttaacggaccgttaaacctttaacgtttaccgttacggtaaccggtaagtaaccgttaaggtttaacgtttttaacgggaaacccggttccccgttaacggttacccgggtttaccggggggacccggggggtaaccgtacggggggtaacggtaaccgtacggaacggtaaccggttaaacgttcgggtacggttccgttcggacctaaccgtgttccgttcgtaccttaccgtaactttccccgtccccg

SEQ ID NO: 303964 - DNA, 591 bp, Homo sapiens
  misc_feature: GZ8MTXP01AE2OR.44.2.A02.1.454.CMB.2.raw
  modified_base (314)..(314): a, c, t, g, unknown or other
  misc_feature (314)..(314): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagagggccaccatcacctgcaagtccagccacaaccttggatacaggtccaacgttgagtaattacgttggtttaggtatcaaacagaaggcaggacagcctctaggttcctcgagtttacggganatccgaggcgggcacgtccgggggtccctggacccgattcccgagcgtccgaggccggggtctggggcagacttcgcactcaccatcaacggcctgcgagggtgaacgatcttagactaaacttatactgtacagactagttaattttacggaaacggtcccctacgtacggtttccggggcgggggtaaccgtaggggtcggaacgtcgttaacggaacggttaaacgtggtcgggcttcggacctaacgatcgtgtcttctaacgttcctccccg

SEQ ID NO: 303965 - DNA, 862 bp, Homo sapiens
  misc_feature: GZ8MTXP01A33CV.44.2.A02.1.454.CMB.2.raw
  modified_base (197)..(197): a, c, t, g, unknown or other
  misc_feature (197)..(197): n is a, c, g, or t
  modified_base (817)..(817): a, c, t, g, unknown or other
  misc_feature (817)..(817): n is a, c, g, or t
tcagacagtatatacacgaccggtgctcgatttagactcatctacaggggggaggaactgctcagttaggacccagacggaaccatggaagccccagcgcagcttctcttcctcctgctactctggctcccagataccactggagaaatagtgatgacgcagtctccagccacctgtctgtgtctccgaggggaaancgcccaccctctcctgcgagggccagtcagagttgtacccagtctaacgttagcctacggtaacccaccgaaggaaacccgtggggaccacgggccctaccccggaggtccctacccgttacacttccgtaagtacgggtaaacccacgttaccccccgaaccggaacgggggtccccccttaacggttacccggggttaaccctaccccccccgtaaaccccggttagggggttttaccccgaagggggtttcggggacccgggttaacggggggttcccccggggggtaccccggggaaacgtaacgggttacggtttaccccaaaacccgttcccgtaaccaaaccccgtattacccggacgggtcccgggtacccttgggaccctaaggttccgtagggtacgggtttattttacggacgttttaaaggttttactttaacgtcgttaaccgagtaacgttaagtttaaaccttaacggttaaaccgttcggggttaccccttacgtaccggtttaaccggggtttccgggggaaccggggggtaacctagggggttaacggagtaaaccgtacggtaaaccgtaagttcgggtcgacgtacgtaccaaccggttnttccgttcttccgttaacctcgttcccgttacctcgttaacgtcg

SEQ ID NO: 303966 - DNA, 684 bp, Homo sapiens
  misc_feature: GZ8MTXP01DB5TF.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacagtaccaacgttgagtaattacgttggttggtatacaacagaagcaggacagcctctaggtcctcagtttacggactactccgaggccgggcacggttcccggggtaccctcggaccgtacttcccgacggccgaccgacggtccggggtacgttacggggaacctacggtacccttccgggaccaccgtacccaccgaacgttacccgaaaccgggtcctacgggaccgaaggggttagaaacgtcttacgttacgacttaaacttagttactcgtacgtaacgtcttaagtttacgtttacggaaacccgtcccgttacgtaccggtttccgggggaccgggggtactacggggttagaaaccgtcgaacggaccgttaacggttcggtcggacgttcggaccctaacccgtattccgttacggttcttacctaacgttccccttaaccccg

SEQ ID NO: 303967 - DNA, 734 bp, Homo sapiens
  misc_feature: GZ8MTXP01BGY7V.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacagtcgtgctgacccagtccccagacctccctggctgtgtctcgtgggcgagacggccaccatcacctgacagtccagccacaccttgatacgagtccaacgttgagtaattacgttggttagtatacaacgagaaggcaggacacgtcctacgtacggttcctacgtagttacggactagtccgaggcggctacggtccgggtccctagacccgtattacccgacggcggaccgagggtccgggtacgtacggggaacacgtaacccgttccgacctaaccgtaccacccgtactaccgaaccggcctacggaccggagggttagaaacgtacgttacctttacggaaccttaaactttacgttaacgtcggttaccggtaagtaccgttacgttttaaacgtttaccggaaaacccggttcccccgtacggtttaaccggggtttacccgggggaccgggggtaaacccggtacgggggtaaccgggtaaacgttccgggaaacggtaccggttaaacggtcggtacgggttacgttgaccccgtaacgttcgtaaccgttcgtacctttcctaaccttccgttaaccccg

SEQ ID NO: 303968 - DNA, 789 bp, Homo sapiens
  misc_feature: GZ8MTXP01DFB19.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagacgggccaccatcacctgcaagtccagccacaaccttggatacaggtccaacgttgagtattacgttggtttagatcaaacagaaggcaggacagcctctaggttcctctagtttacggacatccgaggcgggcacgtcccgggtcctggaccgacttccgacggtcgccgtacggccgggtacgtacgggaacgacgtaccgtttccggacctacctaccgaacctacgtacccgaaaccgggtccgttacgggaccggtaaggggttaacgaaaacggtacttaccgtttacggtaaccttaaaacttttaacgtttaaccgttacggttaccgtaaacggtaccgtttaaagggttttaacgtttttaaacgggaaaacccggttcccccgtttaaccggtttaaacccggggttttcccgggggaacccgggggggtaaacccggtaacggggggtttaaccgggtaaacccggttacggttaaacgggtaacccggttaaacggttcgggtacgggttacccgtttcggaccccgtaacccgtacgtttccgttcggttacccgtttacctaaccgtttccccgtttaacccccg

SEQ ID NO: 303969 - DNA, 669 bp, Homo sapiens
  misc_feature: GZ8MTXP01EA7I1.44.2.A02.1.454.CMB.2.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgcgtctcgtgggcgagacgggccaccatcacctgcaagtccagccacacttgatacaggtcaacgttnagattntggttgancaanagaagcaggacagcctctaggttcctctagtttaccggganatccgaggcggcacgtccgggtcctgaccgtattcccgacgcgccgtaggccgggtcgtagggctagtaaccgttcgactaaccgtaccaccgactaccgaaacggtcctaggccgtagggtagaaaacgtcgttacttacggacttaaacgttcttaaacgttacgtaccggtaacgtaccgttaaaggtttaacgttttacggaaaaccggttccccgttacgtaaaccgggttttccgggggaccgggggtaccgtacgggggtacggaaacctacggttacggaaccggttaacgtacggttcgggacttcggacctaaccggtaacgttcctcggttaccttaccttaacttcccgttccccg

SEQ ID NO: 303970 - DNA, 661 bp, Homo sapiens
  misc_feature: GZ8MTXP01BRV0M.44.2.A02.1.454.CMB.2.raw
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacagtcgtgctgacccagtccccagacctccctggctgtgtctcgtgggcgagacggccaccatccacctgacaagtccacgccacacttggatacaggtccaacgttgagtaattacttggttgtatcaacagaaggcagacagcctctaggtcctctagttacggacatcgaggccggnacgtcccggggtcccnggaccgtnttacccgacggcgccgaggtccgggtactagggcagtactttgctaccgtacacactacgaacgtccgtagcgagggtagaacgtacgttacgttagacctaactttattacgtacgtacgtaacgtacgttaaggtttacgtttaacgaaacccggtcccccgttacggtaccgggtttccgggggacccggggggtaaccgtacgggggtacggtaaacgtcggaaacgtaccggttaaacgtcgggtaccggcgttcgcccgtaaccgtcttccgttcgttacctttcgtaaccctttcccggtttaacccccg

SEQ ID NO: 303971 - DNA, 701 bp, Homo sapiens
  misc_feature: GZ8MTXP01CFQL7.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctcgacccagtccccagactccctggctgtgtctcgtgggcgagacggccaccatcacctgacaagtccagccacaaccttggatacgagtccaacgttgagtaattcgttggttagatacaacagaaggcaggacacgcctcgtacgtcctgtacgttacggacagtccgagggccgggacgtacggtcccgggggtccctacggaccgtagttaccccgacggccgtacccgagggcggggtaacccgtcggggaaccacgtacccgttccggcctaacctccgaaaccactaccgaaccggtcctcggacgtagggtagaacggttacttcgtactacgtaaactttaagttacgtacgtacggtagtaccgttaagtttacgtttaacggtaaaacccggtccccgttacggtaaccggtttccgggggtaccgggggaccggtagggtaacgggtaaaccgtacggacgtaaacggttaaacgtcggttcggacgttcgaccgtaacctagttccggttcgtaccgttcgtaacttccccgttccccg

SEQ ID NO: 303972 - DNA, 674 bp, Homo sapiens
  misc_feature: GZ8MTXP01DJWDT.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgaggacgggccaccatccacctgacaacgtccacgaccaactaaccttggaactacgacggtaccaacgttagaagtaattacgttggtttagtatacaacgagaaggacaaggacacgtccttccgtaaggttcctacgtagtttacgggacatccgaggccgggcacggtcccgggtccctagaccgtacttccacggcgccgacggcgggtacgtgggaacagtaccttcgacacctacacataccaacggcctagcgagggtacgaagtacttcgtagacttaacgttattacgtcgtacgtaagtacgttaagtttacgtttacggaaaccgttccccgttacggttaaccgggtttccgggggaccgggggttaaccgacgggggttaacgaacgtacgaacggtacggaaacgttgggtcgttacgttcggacctaacctacttcgtacgttcttacttaaccgttcccgttaaccccg

SEQ ID NO: 303973 - DNA, 505 bp, Homo sapiens
  misc_feature: GZ8MTXP01BCOAN.44.2.A02.1.454.CMB.2.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagacggccaccatcacctgcaagtccagccacaacctggatacagtccaagtnagaattactgttgancaanagaaggcaggacagcctctagtctcaatttacggacatcaggcggcagtccgggtcctgaccgtattccccagcgccagtcgggtacagggcagacttcgcaactcaccgatcaacggctgcaggggtanaanatctananaataatatntcgantagtagttagtaacgcctctacgtcggtcgggacggaggngaacgtacgagacgacgtagtgcgcncaacactctntcttctcttctccg

SEQ ID NO: 303974 - DNA, 820 bp, Homo sapiens
  misc_feature: GZ8MTXP01D911I.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgcaagtccagccacacttggatacaggtccaacgttgagtaattacgttggttaggatacaaacaggtaacggcagggacaggtacccttccgtaaggttccctacgtaagttttaccggggaactagttccccgaagggcccggtaaacgtacggttccccgggggttaccctaggaacccggtatttccccgacggccgaccgagggtcccggggtacttacgggggaacctacggtaaacctttccggacctaaccgttcccgaaccgtaaaccgttacccgaaaccgggtcccttcggaccggtaaagggggttacgaaaacggttacgttaccgtttacggaaccgttaaacctttaacgttacgtttacgttacggtaaacggttaccgttaaaggttttaacgttttaaacgggaaacccggttcccccgttacgttaaccgggttttaccggggggaccggggggttaccgaacgggggtttacggaaacccgttcggttaaacggtaaccggttaaaccgtcgggtacgggttaccgttcggaaccgtaacccgtaattccggtttacgtcctttacccgttaacgttccccggtttaaccccg

SEQ ID NO: 303975 - DNA, 525 bp, Homo sapiens
  misc_feature: GZ8MTXP02GXQRX.44.2.A02.1.454.CMB.2.raw
  modified_base (359)..(359): a, c, t, g, unknown or other
  misc_feature (359)..(359): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagaattacttggttggtatcaacagaaggcaggacagcctctaggttcctcatttacgggacatccaggcgggcatccggggtcctgaccgattccagcgccagcgggtctgggcngacttcgcactcaccatcaacgcctgcagggtgaagatcttgcaacttattactgtcagcagttatttagaaacggtcccctctacgtttcggcgggggtaccaggggtcggaaacgtcgagacgaaacgtgtacgctggcaaccgatctgtcttcactcttcccg

SEQ ID NO: 303976 - DNA, 522 bp, Homo sapiens
  misc_feature: GZ8MTXP02H3Y5F.44.2.A02.1.454.CMB.2.raw
  modified_base (302)..(302): a, c, t, g, unknown or other
  misc_feature (302)..(302): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggtttgatcaacagaagcaggacagcctctaggttcctcatttacggganatccaggcgggcatccggggccctgaccgattcccagcgccagcggtcngggcngacttcgcactcaccatcaacgcctgcaggtgaagatcttgacacttattactgtcagctagtatttagaaagccctatacgtttcggacgggggaccaggggttacggaaacgtcgaaggaccgaaatcgtgggccttgcaaccatccgttctctctactctccg

SEQ ID NO: 303977 - DNA, 533 bp, Homo sapiens
  misc_feature: GZ8MTXP02G4YXI.44.2.A02.1.454.CMB.2.raw
  modified_base (395)..(395): a, c, t, g, unknown or other
  misc_feature (395)..(395): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaagttgagaattacttggttggtatcaaacagaaggcaggacagcctcctaggttcctcatttacgggacatccaggcgggcagtcccggggtcctgaccgattccagcgccagcggtctgggcagacttcgcactcaccatcaacgcctgcgagggtnaagatcttgactaacttattactgtcagctagttatttagaaacggtcccctagtacgtttcgggcgggggtaccaggggtcgaactcgagacgaaactggtcggactgacaaccgatctcgtcttcactccttcccg

SEQ ID NO: 303978 - DNA, 526 bp, Homo sapiens
  misc_feature: GZ8MTXP02HKFYT.44.2.A02.1.454.CMB.2.raw
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaacttggatacaggtccaagttgagaatacttgttgatcaacagaagcaggacagcctctaggtcctcattacgganatccaggcgggcagtccggggtcctgaccgattccagcgccagcggtntgggacngactcgcactcacatcaacgcctgcaggtnagatctgctaattattactgtacagtacagttatttagaaaggtcccctagtacgtttcgggcgggggtacctaggggtacgggtaactcgaacggacgaaacgtggtacggctggccaaccagtctacgtcttcacttctccccg

SEQ ID NO: 303979 - DNA, 517 bp, Homo sapiens
  misc_feature: GZ8MTXP02GFHM2.44.2.A02.1.454.CMB.2.raw
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttggtatcaacagaaggcaggacagcctctaggttcctcatttacgggacatccaggcgggcatccggggtcctgaccgattccagcgcagcggtctgggcagacttcgcactcaccatcaacgcctgcagggtcgaagntcttgcaacttattactgtcagcagtatttagaaacggtccctanacgtttcgggcgggggtaccaggggtcggaactcgagacgaaacgtgcgactgcaacgatctgtacttcactctcccg

SEQ ID NO: 303980 - DNA, 715 bp, Homo sapiens
  misc_feature: GZ8MTXP02J4EH2.44.2.A02.1.454.CMB.2.raw
tcagacagtatatacacgaccggtgctcgatttagactcatctacaggggccacaacaggcaggcaggggcagcaagatggcgctgcagacccaggtcttcatttctctgttgctctggatctctggagccgtacggggacatcgtgctcgacccagtcccagacctccctggctgtgtctcgtgggcgagacggccaccatcactgcaacgtccagccaacaaccttggatacgaggtacccaaggttgaagtatttacgttggttggatacaaacgagaaggcaggacacgtcctaccgtaggttcctagtacgttacggactacgtccggacgggcgggctacggtcccggggtcctaggaccgtacttcccgacggccgacccgtacggggtcggggttacgtacggggaccaacgtaacccgtttccggaccaacccttacccaaaccgtacgtacccggaaacccgggcccgttacgggaccggtaacgggggtaagtaaacgggtaccttaccggtttacgaacctttaaactttacttaaccgttgttaccgacggtacttaaggtttacggttttacggaaaccgtcccccgttacggtaaccgggtttccgggggaccgggggtaccgtaacggggtacgtaaccgacgaacggaccgacgttggcgcctgacccaacgtctctacgttctactacttcctcccg

SEQ ID NO: 303981 - DNA, 612 bp, Homo sapiens
  misc_feature: GZ8MTXP02HWLPM.44.2.A02.1.454.CMB.2.raw
  modified_base (418)..(418): a, c, t, g, unknown or other
  misc_feature (418)..(418): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttggtatcaacagaaggcaggacagcctctaggtcctctagtttacggacatccgaggcggcacgtccggggtcctggaccgtattcccgagccgccgaggcggtctggggacagaccttcgcctacgtccaccgatccgaaacggcctgcgagggtagaagtntcgttgactaaacgttattacttgtcagtactagtttagtttacgaaacggtccccttacgtaccggtttcggggaccgggggtaccgagggggttacggtaaaccgtcggaaacggtaccggaaacggttcggtacggtcgtcggacctaaccgtacgttacgttcgtctttacctactttcccgttcccccg

SEQ ID NO: 303982 - DNA, 581 bp, Homo sapiens
  misc_feature: GZ8MTXP02H891I.44.2.A02.1.454.CMB.2.raw
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcagaggccacatcacctgcaagtccagccacaactgatacaggtccaagttgagaattacttggttgtatcaacagaagcaggacagcctctaggttcctcagtttacggacagtccaggcgggcagtcccggggtccctgaccgattcccagccgccaggcggtctgggcagacttcgcactcaccatcaacgcctgcgagggtgaagatcttagactaacttatactgtacagtctagttatttagaaacgtcccctagtaccgtttcgggaccgggggtaccgtaggggtacggtaaccgtacgacggaaacgtaaaccgtaggttcggaccttacggacctaacccgtagttaccgttcggttacctttccgtaactttaccccgtttccccg

SEQ ID NO: 303983 - DNA, 555 bp, Homo sapiens
  misc_feature: GZ8MTXP02GEYA9.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaagttgagaattacttggttgtatcaacagaaggcaggacagcctcctaggttcctcatttacgggacagtccgaggcgggcacgtcccggggtccctgaccgtatcccgagccgccagcgggtctgggcagacttcgcactcaccatcaacgcctgcgagggtgaagatctgactaacttattactgtacagtctagttatttagaaacgtcccctagtacgtttcgggcgggggtaccgtaggggtacgaacgtcgaagacgtaaacgtcggtacggcgtcgacaaccgactcgtcgttctactacttccttcccg

SEQ ID NO: 303984 - DNA, 540 bp, Homo sapiens
  misc_feature: GZ8MTXP02IPYRT.44.2.A02.1.454.CMB.2.raw
  modified_base (291)..(291): a, c, t, g, unknown or other
  misc_feature (291)..(291): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggttcaacgttgagaattacttggttggatcaacagaagcaggacagcctctagtcctnattacggacatcaggcggcagtccgggcctgaccgattccagcgccagcggctgggcagactcgcactcacatcaacgctgcgaggtgaagatcttgactaacttattaactgtacagtacagttatttagaaaacgtcccctactacgtttcgggacgggggtaacccaggggtacggaacgtcgaacggaacgaaacgtcggtaggaccgtgaccaaccgatcgttcgtccttcacttcgtaccccg

SEQ ID NO: 303985 - DNA, 523 bp, Homo sapiens
  misc_feature: GZ8MTXP02F5BT3.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagaattactggttggtatcaacagaaggcaggacagcctcctaggttcctcatttacgggacatccaggcgggcagtccggggtcctgaccgattccagcgcagcggtctggggcagacttcgcactcaccatcaacggcctgcagggtgaagatctgcaacttatactgtcagcagtatttgaaacggccctacacgtttcggcgggggtaccaggggtcggaactcgaggacgaaacgtggtcggctggcaacgactctcgtcttcactcttccccg

SEQ ID NO: 303986 - DNA, 577 bp, Homo sapiens
  misc_feature: GZ8MTXP02I0AIE.44.2.A02.1.454.CMB.2.raw
  modified_base (375)..(375): a, c, t, g, unknown or other
  misc_feature (375)..(375): n is a, c, g, or t
  modified_base (410)..(410): a, c, t, g, unknown or other
  misc_feature (410)..(410): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgaagtaattacttggttggtatcaaacaggaaggcaggacagccctcctaggtcctcagtttaccgggacatccgaggccgggcacgtcccggggtcctgaccgtattccgacgcgccaggcggtctgggacngactcgcactcacatcacgcctgcgagggtgaagntctgactaacttattactgtacagtctaagttagtttacgaaaccgtccctacgtacggtttcggggacgggggtaaccgtagggggtacggtaaacgtcgaacggtacggtaaacgtggtacggctcggcaaccgacttcgtcgtccttactaccttccgttcccg

SEQ ID NO: 303987 - DNA, 550 bp, Homo sapiens
  misc_feature: GZ8MTXP02ISC5J.44.2.A02.1.454.CMB.2.raw
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttggtatcaaacagaaggcaggacagcctcctaggttcctcatttacgggacatccaggcgggcagtccggggtccctgaccgattccagcgccagcggtctgggcngacttcgcactcacntcaacgcctgcaggtgaagatcttgacaacttattactgtcagtctagtatttagaaacggtcccctacgtacgtttcggggcgggggacctaggggtcggaaccgtcgaacggacgaaacgtcggtacggctgccaaccgtagtcttacgtctttacacgttccttaccccg

SEQ ID NO: 303988 - DNA, 668 bp, Homo sapiens
  misc_feature: GZ8MTXP02I60RF.44.2.A02.1.454.CMB.2.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgcaagtccagccacaaccttggatacaggtccaacgttgaagtaattacgttggttgtatacaacaggaagcaggacagccctccgtaggttcctnagtttacggacatccgaggcggcacgtcccgggtccnggaccgtatccgacgccgccgaggtcgggtctggggaccaggtaccttccggacctaccgtaccaaccgtactaccgaaaccggtccctaggaccgtaagggggtacgaaaggtacttaccgttagaccttaaactttacttacgtgtaccagtactaagtttagtttacggaaaccgtccccttacgttaaccgggtttaccgggggaccgggggtaaccgtaagggggtacggtaaacctacggaacggtaccgtaaacggttggtcggtaccgtacgaccaaccgttactccgttcgttacctttacctacgttcccgttccccg

SEQ ID NO: 303989 - DNA, 593 bp, Homo sapiens
  misc_feature: GZ8MTXP02HSIZ8.44.2.A02.1.454.CMB.2.raw
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaacctgatacaggtccaacgttgagtaattacttggttggtatcaaacataaggcaaggacagcctcctaggttcctnatttacgggacatccaggcggcagtcccggggcctgaccgtatcccgagccncaggcggtctgggcagacttcgccactcaccatcaacgcctgcgagggtagaagactcttagactaaactttattaaccgttgtacagtctaagttaagttttacgaaacggtaccccttacgtaaccggtttcgggaccgggggtaccgtaggggtacggtaaacgtcgtaacggaacgtaaacgttcggtacggtcgtacgacaacccgtatccgttcgtacctttcctactttccttccccg

SEQ ID NO: 303990 - DNA, 568 bp, Homo sapiens
  misc_feature: GZ8MTXP02GO2WC.44.2.A02.1.454.CMB.2.raw
  modified_base (336)..(336): a, c, t, g, unknown or other
  misc_feature (336)..(336): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagaattacttggttgtatcaacagaagcaggacagcctctaggttcctcattacggacatccaggcgggcagtcccggggtccctgaccgtntccgagccgcgaggcggtctggggcagcttcgcactcacatcacgcctgcgaggtgagatcttgactaacttatactgtacagtctagttatttacgaaaccggtccccttacgtaccggtttcggggaccggggggtaaccgtaggggtacggaaacgtcgaaggacggtaaacgtggtcggcgttacgacctaaccgtacgtacttcgtcctttactacttccttccccg

SEQ ID NO: 303991 - DNA, 556 bp, Homo sapiens
  misc_feature: GZ8MTXP02I0K1T.44.2.A02.1.454.CMB.2.raw
  modified_base (430)..(430): a, c, t, g, unknown or other
  misc_feature (430)..(430): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcttggcgagaggccaccatcacctgcaagtccagccacaaccttggatacaggtccaagttgaagtaattacttggttggtatacaaacagaaggcaggacagcctctaggtcctcattacggacatccgaggcgggcacgtccggggtccctgaccgtattcccgagcgccaggcgggtctggggacagacttcgacactcaccatcaacggcctgcgagggtcgaaagctcgttgactaattattacngtcagtctagttatttagaaacgtcccctagtacgtttcgggacgggggtaccgaggggtacggaacctcgaacgacgaaacgtggtacggctgaccaacgtatctacgtcttacgactctccccg

SEQ ID NO: 303992 - DNA, 547 bp, Homo sapiens
  misc_feature: GZ8MTXP02HROTA.44.2.A02.1.454.CMB.2.raw
  modified_base (338)..(338): a, c, t, g, unknown or other
  misc_feature (338)..(338): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccacatcacctgcaagtccagccacaaccttggatacaggtccaagttgagattacttggttgatcaacagaagcaggacagcctctaggttcctcattacggacatccaggcgggcagtccgggtcctgaccgtattccagccnccgagcggtcctgggacagacttcgcactcacatcaacgcctgcagggtnaagtntctgactacgttatactgtcaagtctagttacgtttagaaacgtccctagtacgtttcggggacgggggtacctaggggtacgtaacctagacggaacgtaaacgtggtacggctacggcaaccgtagtcgttcgtccttcactttcgtacccg

SEQ ID NO: 303993 - DNA, 558 bp, Homo sapiens
  misc_feature: GZ8MTXP02IX4M0.44.2.A02.1.454.CMB.2.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctctgggcgagacggccaccatcacctgcaagtccagccacaaccttgatacagtccaagtgagattactggttgtatcaanagaagcaggacagcctctagtcctnatttacggacatccaggcggcagtcccggggtcctgaccgtattccagccgccaggcggtctgggacngacttcgcactcacatcaacgcctgcgaggtgaagntctgactaacttattactgtcagctagttatttagaaacgtcccctacgtaccgtttcggggacgggggtaccgaggggtacggaaccgtacgaacgaacggtaaacgtggtacggaccgtcgaccgaacccgtattcgttcgtacctttctacttcccttcccccgg

SEQ ID NO: 303994 - DNA, 526 bp, Homo sapiens
  misc_feature: GZ8MTXP02GJWB3.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaagttgagaattacttggttgtatcaacagaaggcaggacagcctcctaggttcctcatttacggacatccgaggcgggcagtccggggtccctgaccgattccagcgccagcggtctgggcagacttcgcactcaccatcaacgcctgcagggtgaagatcttgactaacttattactgtcagtctagtatttagaaacggtccctacgtacgtttcgggcgggggaccgaggggtcgaacgtcgagacgaacgtgtacgctgcaaccgatctcgtctcactctcccg

SEQ ID NO: 303995 - DNA, 535 bp, Homo sapiens
  misc_feature: GZ8MTXP02JUL12.44.2.A02.1.454.CMB.2.raw
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccacatcacctgcaagtccagccacaaccttggatacaggtccaacgttgagaattacttggttgtatcaacagaaggcaggacagcctctaggtcctcatttacggacatccaggcgggcagtccggggtcctgaccgattcccagccgcagcggtcngggcngctcgcactcaccatcaacgcctgcagggtgaagntcttgactaacttattactgtcagctagttatttacgaaacggtcccctacgtacgtttcgggccgggggtacgaggggtacggaacgtcgagacgaacgtggtacgctggcaaccgtactcgtcgttcttcactccttacccg

SEQ ID NO: 303996 - DNA, 626 bp, Homo sapiens
  misc_feature: GZ8MTXP02JVL4I.44.2.A02.1.454.CMB.2.raw
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtcccccagacctccctggctgtgtctctgggcgagaggccaccatcacctgcaagtccagccacaaccttggatacaggtccaacgttgagtaattacttggttgatcaaacagaaggcaggacagccctcgtaggttcctctagttacggacatccgaggcggcacgtcccggggtcctgaccgtatcccgagccgcgaggcggtcngggacnggaccttcgacactccaccataccgaacggccctgacgagggtanaagtactcgttagacctaacgtttattaccgtgttaccagtacgtaagtttactttacggaaaaccgtcccccttagtaaccggtttcgggggaccgggggtaacccgtagggggtacgtaaaccgtcggaaacggtaccgtaaacgtcggtacggcctacggaccaaccgtcgttaccttaggttcccttacttaccgttttcccccgcg

SEQ ID NO: 303997 - DNA, 558 bp, Homo sapiens
  misc_feature: GZ8MTXP02ICQ33.44.2.A02.1.454.CMB.2.raw
  modified_base (374)..(374): a, c, t, g, unknown or other
  misc_feature (374)..(374): n is a, c, g, or t
  modified_base (415)..(415): a, c, t, g, unknown or other
  misc_feature (415)..(415): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctctgggcgagagggccaccatcacctgcaagtccagccacaaccttggatacaggtccaacgttgaagtaatttacgttggttgtatacaaacaggaagcaggacagccctctaggttcctctagtttacgggacagtcccgaggcggcagtcccggggtcctgaccatcccagccgcgaggcggtctgggacngtactcgcactcacatccgaacgcctgcgagggtgaaagtntctgactaacttatactgtcagtctagttatttacgaacgtccctagtacgttcgggacggggtacaggggtacgtaactcgaagacgtaacgtcgtacggctacgaccaacgtctcgtcgttcttacctacttccctccccg

SEQ ID NO: 303998 - DNA, 549 bp, Homo sapiens
  misc_feature: GZ8MTXP02IKN40.44.2.A02.1.454.CMB.2.raw
  modified_base (301)..(301): a, c, t, g, unknown or other
  misc_feature (301)..(301): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccacatcacctgcaagtccagccacaaccttgatacaggtccaacgttgagaattacttggttgtatcaacagaaggcaggacagcctctaggtcctcattacggacntccaggcggcagtccggggtcctgaccgattccagcgccaggcggtctgggcagacttcgcacctcaccatcaacgcctgcgagggtgaagatcttagactaaacttattactgtacagctaggttactttagaaacggtcccctagtacgtttcggggcgggggtaccgtaggggtcggaaactcgaaggtaccgaaacgtggtacgccgtgaccgaacattccgtcgtccttcacttcgttccccg

SEQ ID NO: 303999 - DNA, 573 bp, Homo sapiens
  misc_feature: GZ8MTXP02FW4YY.44.2.A02.1.454.CMB.2.raw
  modified_base (443)..(443): a, c, t, g, unknown or other
  misc_feature (443)..(443): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagaggccaccatcacctgcaagtccagccacaaccttggatacaggtccaacgttgagaattacttggttggtatcaaacagaaggcaggacagcctcctaggttcctcagtttacgggactagtccgaagggccgggcacgtcccggggtccctggacccgattcccgagccgcaggcgggtctgggcagacttcgccactcacatacgaacggcctgacgagggtagagatcttgactaaacttattacgtntacagctagttatttagaaacgtcccctctacgtttcgggcgggggactaggggtcgaacgtcgaaggacgaaacgtggtcgacgtcgaccgaacctaacgttctcgttcttcgtacttccgttaccccg

SEQ ID NO: 304000 - DNA, 548 bp, Homo sapiens
  misc_feature: GZ8MTXP02HIP0K.44.2.A02.1.454.CMB.2.raw
  modified_base (296)..(296): a, c, t, g, unknown or other
  misc_feature (296)..(296): n is a, c, g, or t
  modified_base (377)..(378): a, c, t, g, unknown or other
  misc_feature (377)..(378): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccaccatcacctgcaagtccagccacaaccttggatacaggtccaacgttgagtaattacttggttgtatcaaacagaaggcaggacagcctctaggttcctnattacggacatcgaggcggcagtcccggggtcctgaccgattcccgagccgcaggcggtctgggcagtactcgcactcacnncacgcctgcgaggtnaagtntcttagactaacttattacgtgtcagtctagttacgtttagaaacggtccctagtacgtttcggggccgggggaccgtagggtacggaactcgagacgtaagtcgtcggactgaccaaccgattcgtcgtactttccgacttcctccccg

SEQ ID NO: 304001 - DNA, 594 bp, Homo sapiens
  misc_feature: GZ8MTXP02GUPPE.44.2.A02.1.454.CMB.2.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccanaaccttggatacaggtccaagttgaagaattacttggttggtatcaacagaagcaggacagcctcgtagttcctcagtttacggacatccgaggcgggnagtcccggggcctgaccgatccagccgcagcggtcngggacngactcgcactcaccatcaacgccngcagggtnaagntctagctaaacgttattaactgtacagtacgtagtttagtttagaaaccggtcccctacggtaccgtttcggggaccgggggtaaccgtaggggtacggaaacctcggaaaggaaccgtaaacgtgggtacgggtaccgtaggacccgaaccgtacgtttaccgtacggttccctttaccgtacttacccctttccccg

SEQ ID NO: 304002 - DNA, 760 bp, Homo sapiens
  misc_feature: GZ8MTXP02H7ET7.44.2.A02.1.454.CMB.2.raw
  modified_base (304)..(304): a, c, t, g, unknown or other
  misc_feature (304)..(304): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacgggccaccatcacctgcaagtccagccacaaccttgactacaggtaccaacgttgaagtaattcgttggttagtatacaacagaaggcaggacacgcctcgtaggttcctntacgtttaccgggacagtccgagggccgggctacggtccccggggtccctaggaccgtattcccgacggccgccgaggtcgggtcgttggggaccaggtaccttccggcctactcccaacctactacccgaaccggtccctggacggaacgggggtacaaaacggtcgttaccgtttacggaacctttaaacgtttaactttacgttacgttaacccgtaaggttaccgttaaaggttttaacgtttttaacgggaaaaaccccggttcccccgttaacggtttacccgggttttaaccggggggacccggggggtaaaccgtaacgggggttaccggaaacgtttaccggaaacgggtaaaccggtaaacgttcgggtacggtccgttacggtacccaacccgttaagtttcccgttacgttacctttcccgtactttacccccgtttacccccg

SEQ ID NO: 304003 - DNA, 541 bp, Homo sapiens
  misc_feature: GZ8MTXP02GVZ2E.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttggtatcaaacagaaggcaggacagcctctaggtcctcatttacggacatccaggcgggcagtcccggggtcctgaccgattcccgagcgcagcggtctggggcagacttcgcactcaccatcaacgcctgcgagggtgaagatcttgactaacttattactgtacagtcagttatttagaaacgtccctacgtacgtttcgggccgggggtaccgaggggtcgaaccgtcgaaggacgtaacgtggtcgctgacaaccgtatctcgtcttacacttccttcccg

SEQ ID NO: 304004 - DNA, 602 bp, Homo sapiens
  misc_feature: GZ8MTXP02IRRR8.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgaccccagtccccagactccctggctgtgtctctgggcgagagggccaccatcacctgcaagtccagccacaacttggatacaggtccaacgttgagaattacttggttggtatcaaacagaaggcaggacagcctcctaggtcctcatttacgggacatccaggccgggcagtccccggggtccctggaccgtattcccgagccgccgaggccggggttctacggggcagtaccttccgcctaccgtcaacctatccgaaacggccctggaccgaggggttcgaaaggtacttccgttaggacctaaacgtttatttacgtcgttacagtctaagtttagtttacgaaacgtcccctagtacgtttcggggacgggggtaccaggggtcgaaactcgaagacgtaactggtacggctacgccaacgtatcttcgtcttcacttccgtacccg

SEQ ID NO: 304005 - DNA, 574 bp, Homo sapiens
  misc_feature: GZ8MTXP02INFXU.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttgatacaggtccaacgttgagaattacttggttgtatcaacagaagcaggacagcctcctaggttcctcattacgggacatccaggcggcagtcccggggtccctgaccgattccacgcgccgaggcgggtctgggacagtaccttcgacaccgtcaacctataccgaacgccctagcgaggggtacgaaagtacttcgttagacctaacttattacctagttccagtactaagtttagtttaacgaacgtcccctagtaccgtttcgggacgggggtacaggggtacgacctcgagacgaacgtgtcggactgaccgaacgactcgtacgtcttacacttccgtacccg

SEQ ID NO: 304006 - DNA, 599 bp, Homo sapiens
  misc_feature: GZ8MTXP02GFUGO.44.2.A02.1.454.CMB.2.raw
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagagggccaccatcacctgcaagtccagccacaaccttggatacaggtccaacgttgagaattacttggttggtatcaacagaaggcaggacagcctctaggttcctcatttacgggacatccaggcgggcagtcccggggtccngaccgattccagcgcagcgggtctgggcagacttcgacnctcacatacaacggcctgcgagggtgaagatcgttgactaaacttagttactgtaccagcgtagttatttagaaaacggtcccctacgtaccggtttaccggggccgggggtaaccgagggggttacggtaaaccgtcgaaacggaaccggtaacgtaggtcggtacgttcggacctaaccgtacgttccgttacggttccctttacgacctttccgtttcccccgg

SEQ ID NO: 304007 - DNA, 539 bp, Homo sapiens
  misc_feature: GZ8MTXP02H5N1F.44.2.A02.1.454.CMB.2.raw
  modified_base (267)..(267): a, c, t, g, unknown or other
  misc_feature (267)..(267): n is a, c, g, or t
  modified_base (394)..(394): a, c, t, g, unknown or other
  misc_feature (394)..(394): n is a, c, g, or t
  modified_base (452)..(452): a, c, t, g, unknown or other
  misc_feature (452)..(452): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccacatcacctgcaagtccagccacaaccttggatacaggtccaacgttgagaattacttggttgtatcaaacngaagcagacagcctctaggttcctcatttacggacatccaggcgggcagtccggggtccctgacccgattcccagcgccaggcgggtctgggcagacttcgccactcacatcaacgcctgcagggtnaagatcttgactaaacttattaactgttacagtacagttaatttgaaaacggtccctntacgtttcgggcgggggacctaggggtcgaacgtcgacgaacgaacgtgtacggctgcaaccgatctcgtcttctactcgttccccg

SEQ ID NO: 304008 - DNA, 526 bp, Homo sapiens
  misc_feature: GZ8MTXP02JTMZZ.44.2.A02.1.454.CMB.2.raw
  modified_base (367)..(367): a, c, t, g, unknown or other
  misc_feature (367)..(367): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaacgttgagaattacttggttggtatcaacagaagcaggacagctcctagtcctcattacggacatccaggcgggcagtccggggtccctgaccgtatccagcgcagcgggtctgggcagacttcgcactnaccatcaacggcctgcaggtagaagtatcttagcaaacttatactgtcagctagttatttgaaacgtcccctatacgttcgcgggggtaccgagtacgggaactcgagaacgaacgtgtacggtctgccaaccatctcgtcttctactcctttaccccg

SEQ ID NO: 304009 - DNA, 562 bp, Homo sapiens
  misc_feature: GZ8MTXP02IH81D.44.2.A02.1.454.CMB.2.raw
  modified_base (220)..(220): a, c, t, g, unknown or other
  misc_feature (220)..(220): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagagggccaccatcacctgcaagtccagccanaccttgatacaggtccaagttgagaattacttggttgtatacaacagaaggcaggacagcctctaggttcctcatttacggacatccgaggcgggcagtccggggccctgaccgnttcccagccgccagcgggtctgggcagacttcgcactcacancaacgcctgcagggtnaagntcttagactaacttattactgtacagtctagttatttagaaacggtccctacgtacgtttcggggaccggggtacgtaggggtacgacgtacgacggactaacgtggtacggaccgttcgaccaaccgtattccgttacgtacctttccactttcccttaccccg

SEQ ID NO: 304010 - DNA, 667 bp, Homo sapiens
  misc_feature: GZ8MTXP02HJN7M.44.2.A02.1.454.CMB.2.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacgggccaccatcatctgcaagtccagccacaaccttggatacaggtccaagttganaattactggttggtatcaacagaagcaggacagcctctaggttcctnatttacggacatccagggcggcacgtcccggggtcctgaccgtactcagcgccgaggtcggggtctgggggacaaggtaccgttcgaccacctccaacccagtaccaaaccggccctaggaccgagggggtagaaacggtaacttccgtttacgacttaaacctttaagtttaaccgttcgttaccgaaggtcctaaaggggttttaacttttaacgggaaaacccgttcccccgtacgttaaccgggtttcccgggggacccggggggtaaccgtacgggggttacggaaaccgttacggaaacggaaccggtaaacgttcgggacggtcgtacggtccgactacgttctcgtccttacgtactttccccg

SEQ ID NO: 304011 - DNA, 742 bp, Homo sapiens
  misc_feature: GZ8MTXP02I6X19.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagacgggccaccatcacctgcaagtccagccacaaccttggactacaggtaccaacgttgagtaattacgttggtttgatcaaacagaaggcaggacagcctcgtaggtcctcagtttacggacagtccgaggccgggacacgttcccggggtccctggaccgtattcccgacggccgaccgagggtccgggtcgtggggacctagggtaccgttccggacctacctccgaaacccacgtaccgaaacccggggtccctacgggacggaacgggggtagaaaggtacttacgttacggaaccttaaacctttagtttacctaggttaccacggttacgtaaggtttaacgttttaacgggaaaacccggttcccccgttacgttacccgggtttacgggggaccggggggtaaccgtacgggggttaacggtaaaccgtcggtaaacgggtaaccgggtaaaacttcgggggttacgccgttaccgggaccctaaaacccgtacgtttaccgttacggttcctttaccgtaacctttacccccgtttacccccgg

SEQ ID NO: 304012 - DNA, 540 bp, Homo sapiens
  misc_feature: GZ8MTXP02I6URL.44.2.A02.1.454.CMB.2.raw
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaagttgagtaattacttggttgatacaacagaaggcaggacagcctctaggtcctcattacggacatccgaggcggcacgtcccggggtcctgaccgattccagccgccaggcggtctgggacngaccttcgcactcaccatccaacgctgcagggtgaagntcttgactaacgttattaactgtacagtctagttatttagaaaccgtccctactacgtttcgggcgggggtacgaggggtcggaactcgaaggacgaacgtggtacgcgtgaccaacgatcgtacgtctcacttcctcccg

SEQ ID NO: 304013 - DNA, 588 bp, Homo sapiens
  misc_feature: GZ8MTXP02JKVQ4.44.2.A02.1.454.CMB.2.raw
  modified_base (341)..(341): a, c, t, g, unknown or other
  misc_feature (341)..(341): n is a, c, g, or t
  modified_base (446)..(446): a, c, t, g, unknown or other
  misc_feature (446)..(446): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccagtccccagacctccctggctgtgtctcgtgggcgagaggccaccatcacctgcaagtccagccacaacttggatacaggtccaagttgaagtaattacgttggttgatcaaacagaaggcaggacagcctctaggtcctcagttacggacagtccgaggccgggcacgtccgggtcctgaccgtntccgagcgcgaggccggtctgggaccagtacttccgaccaccgtaccaaccatcccgaaacggccctagcgagggtacgaagactcgtagactaacttacttacngtacagtctaagttactttacgaaacgtcccctcgtacggtttcggggacgggggtaaccgtaggggtacggaaccgtgaacggaacgtaacgtggtcgacgtcgaccgtcctatccgtgtcctttaccgactcccttcccg

SEQ ID NO: 304014 - DNA, 623 bp, Homo sapiens
  misc_feature: GZ8MTXP02JELZG.44.2.A02.1.454.CMB.2.raw
  modified_base (412)..(412): a, c, t, g, unknown or other
  misc_feature (412)..(412): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcagaggccacatcacctgcaagtccagccacaaccttggatacaggtccaacgttgagtaattacttggttggatcaacagaaggcaggacagccctctaggttcctcatttaccgggacatccgaaggccgggcagttccccggggtcctggacccgtattcccgagccgccaggcgggtctgggacagacttcgcactcaccatacgacgcctgcagggtgaagntcttgactaacttattactgtacaggtctaagttacttttagaaacggtccttaccgttcgtaacggtttccggggaccgggggtaaccgtagggggtacggtaacgttacggaacggtaaccggtaaacgttcggttacggccgttacggaacccggtaacccctaagttcccgttacggtttcccgtttaaccgtaccttttacccccg

SEQ ID NO: 304015 - DNA, 520 bp, Homo sapiens
  misc_feature: GZ8MTXP02IW6OG.44.2.A02.1.454.CMB.2.raw
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaaacgttgagaattacttggttgatcaanagaagcaggacagcctctagtctnattacggacatccaggcgggcagtccggggtcctgaccgattccagcgccagcggtctgggacagacttcgcatcacatcaacgcctgcaggtgaaagntcttgacaaacttattactgtacagcagttaatttagaaaacgcccctataccgtttcgggacgggggaccgagggtacgaaacgtcgaaggacgaaactgtaggctgcaaccatctgtctcactctcccg

SEQ ID NO: 304016 - DNA, 542 bp, Homo sapiens
  misc_feature: GZ8MTXP02HJ04I.44.2.A02.1.454.CMB.2.raw
  modified_base (400)..(400): a, c, t, g, unknown or other
  misc_feature (400)..(400): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagaactccctggctgtgtctctgggcgagaggccaccatcacctgcaagtccagccacaaccttggatacaggtccaacgttgagtaattacttggttggtatcaaacagaaggcaggacagccctctaggttcctcatttacggacatccgaggcggcagtccgggtccctgaccgattccagcgccagcggtctgggcagtactcgcactcaccatcaacgcctgcgagggtcaaagntcttgactaacgttattactgtacagtctagttatttagaaacggtccccctagtaacgtttcggggcgggggtaaccaggggtacgaactcgaagacgaactcggtagctcgacaaccgtatctacgtctcactcttcccg

SEQ ID NO: 304017 - DNA, 665 bp, Homo sapiens
  misc_feature: GZ8MTXP02FVPUX.44.2.A02.1.454.CMB.2.raw
  modified_base (391)..(391): a, c, t, g, unknown or other
  misc_feature (391)..(391): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctcgacccagtccccagacctccctggctgtgtctcgtgggcgagacggccaccatcacctgacaagtccagccactaccttgatacaggtccaagttgaagtaattcgttggttagtatacaaacgagaaggcaggacagcctctaggttcctacgtagttacggacagtccgagggccggcacggttccccggggtccctggacccgtatcccgacgccgccgaggcgggtcgtggggacngtaccttcgacctacctacgacctataccgaaccggtccctgacgagggtagaaacgcttcgttacgactaaacttagttacgtgtactaagtacgttaacgtttaagtttaacggaaaacccgtcccccgttacgttaccgggtttaccgggggaccgggggtaacccgtagggggttacggaaaaccgtcgaaaggtaacccggtaagtcgggtcggtaccgtcgacccaaccgtacttccgtacgttaccttacgacctttcccgttcccc

SEQ ID NO: 304018 - DNA, 632 bp, Homo sapiens
  misc_feature: GZ8MTXP02JD90A.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagaggccaccatcacctgcaagtccagccacaaccttggatacaggtccaagttgaagtaattacttggttgatacaacagaagcaggacagcctcgtagtcctctagttacggactatccgaggcggcacggtcccgggtcctgaccgtattcccgacgccgccaggcgggtctcgggacagtacttcgacctacctaccaccactaccgaaccggcctcggaccgtagggtagaagtacgttacgttagaccttaaacgtttactttaaccgtcgttacaacgtcttaaaggtttacgttttaacggaaaccggttccccttaccgtacggtttccgggggaccgggggtaccgtaggggtacggtaaccgtacgaacggtacgtaaacgtcggtacggacgtcgaccgtaacacgtcgtcgtacctctactccctacccg

SEQ ID NO: 304019 - DNA, 600 bp, Homo sapiens
  misc_feature: GZ8MTXP02I6SER.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccaccatcacctgcaagtccagccacaaccttggatacaggtccaacgttgagaattacttggttgtatcaaacgagaaggcaggacagcctcctagtcctcagtttacggactatccgaggccgggcacgtcccggggtccctgaccgtacttcccacgcgccaggcgggtctgggactgaccttcgccaccgtcacctagtaccgaaccggtccctaggacgtaggggtacgaaaggtactcgttagacctaaacttagttacctagtacagtactagttagtttaccggaaaccgtccccttacgtaccggtttacggggccgggggtaccgaggggtacgaaccgtcgaacgacgtaaaccgtgtacgctgacaaccgtatactcgtcttcacttcctacccg

SEQ ID NO: 304020 - DNA, 622 bp, Homo sapiens
  misc_feature: GZ8MTXP02F1000.44.2.A02.1.454.CMB.2.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (506)..(506): a, c, t, g, unknown or other
  misc_feature (506)..(506): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctcgacccacgtccccagacctcccgtggctgtgtctcgtgggcgaggacggccaccatccacctgaccaagtccacgcccaactaaccgttggaactacgacggtacctaacgttgaagttaattacgtttggttaggtaatacgaaacgaggaaggacgaaggacacgtcccttaccgtacggttcctacgtacgtttacggactacgtccgaggccgggactacgggttcccgggtccacggacctntccgacgccgcgacggcggtcgagggacngaccgttcgccactccaacnctaccgacgtcctgacgaggtanaagtntcgtagactagttacttacgtctacgacgtntagttagttacgaaccgtcctacgtcggttcgggcgggacgtagggtacgacgtcgagtacgtaacgtggacgctcgacgtaacgtacgtctacgttcgtacctccgttcctcccg

SEQ ID NO: 304021 - DNA, 573 bp, Homo sapiens
  misc_feature: GZ8MTXP02IVWAI.44.2.A02.1.454.CMB.2.raw
  modified_base (295)..(295): a, c, t, g, unknown or other
  misc_feature (295)..(295): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccacatcacctgcaagtccagccacaaccttggatacaggtccaacgttgagtaattacttggttggtatcaaacagaaggcaggacagcctctaggtcctnatttacggacatccaggcggcagtcccgggtcctgaccgattccagccgcagcggtctgggacagacttcgctaccgtcaccatccgaacgcctgccgagggtagaaagtactcgttacgactaacttatttactgttacagtactagttattttagaaaccggtccccttacgtacgtttccggggacgggggtaacctagggggtacggaacgttcgaaggtacgtaaacgtcggtacggctgacaaccgtatctcgtcttcgacttccgttcccg

SEQ ID NO: 304022 - DNA, 659 bp, Homo sapiens
  misc_feature: GZ8MTXP02HGG4L.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagaggccacatcacctgcaagtccagccacaccttgatacagtccaagttgagtaattacttggttgatacaacgagaaggcaggacagccctcctaggttcctactagtttaccggacagtaccgaggcccgggactacgtccccggggtccctagacccgtattccccgagccgaccgacggtccgggtcgtacggggacctaggtaccgttccggacctaaccgtccgaaaccctaacgttacccgaaaccgggtccccgtaggaccggtaagggggtacgaaaggtacttaccgtttacggaaccttaaacgtttacgttaacgtcgttacacgtctaagtttacgtttacgaaaccgtcccttagtaccggttcggggacgggggtacctaggggtacgtaactcgagaccgtaagtcgtacggacgtcgacctaacgtactcgtacgtctacgtactccgtacccg

SEQ ID NO: 304023 - DNA, 708 bp, Homo sapiens
  misc_feature: GZ8MTXP02I5W1A.44.2.A02.1.454.CMB.2.raw
  modified_base (358)..(358): a, c, t, g, unknown or other
  misc_feature (358)..(358): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctctgggcgagacgggccaccatcacctgcaagtccagccacaaccttggactacaggtccaacgttgaagtaatttacgttggtttaggtatacaaacgagaaaggcaaggacagccctcgtaggttcctctagtttacggacatccgaggcgggcacgttcccgggtcctgaccgtntccgacgccgtacacggtcgggtcgtagggacacgaccttcgaccctacgtccaaccgactaccgaaaccggtccctaggaccgtagggggtacgaaacgtacgttcgttagaaccttaaacgtttaacttacgtagttacaacgttacgttaaggtttaaacgttttacgaaaaccggtcccctacgttaaccggtttccgggggaccgggggtaaccgtacgggggttaacggtaaaccgtacggtaaacggtaaccggtaaaacgttcggttacgggtaaccgttcggaaccctaaccgtacgtttccgttacggttacctttcgtaacctttcccggtttaccccg

SEQ ID NO: 304024 - DNA, 648 bp, Homo sapiens
  misc_feature: GZ8MTXP02GGD7K.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagagggccacatcacctgcaagtccagccacaaccttggatacaggtccaacgttgaagtaattacgttggtttggtatcaaacagaaggaaggacagcctctaggttcctcagtttacggacagtccgaggcggcagtccggggtccctgaccgattcgacgccgccgaggtcggggtacgtcggggaacacggacttacggctactccacataccaacggtcccgtaggacgaaggggtagaaagtaacttcgttagactaaactttattaactgttacaggtactaagttacttttaacggaaacggtcccccttacgtaccggtttacggggccggggggtaaccgtaacgggggtcggtaaaacgttaccgaaggtaaaccggtaacgtacggtcggtacgttacggacctaaccgaacttcttcggttcttactacttcccgttacccggaccg

SEQ ID NO: 304025 - DNA, 623 bp, Homo sapiens
  misc_feature: GZ8MTXP02JIS3N.44.2.A02.1.454.CMB.2.raw
  modified_base (403)..(403): a, c, t, g, unknown or other
  misc_feature (403)..(403): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctctgggcgagaggccaccatcacctgcaagtccagccacaaccttggatacaggtccaagttgagtaattacttggttggtatcaacagaagcaggacagcctctaggtcctcagttacggacatccgaggcgggctacgtcccggggtccctggaccgtattcccgacgccgccaggcgggtctgggcagacttcgcactcaccatcaacgcctgcagggtnaacgtatcgttgactaacgttattaccgtgtcagtctaagttagtttacgaaaccggtccccttacgtaaccggtttccggggaccgggggtaaccgtagggggtacggtaaaccggttacgaacggtaaccggtaaacgtcgggttacgggtaccttcggaccctaaccggtaaacttccgttacggttcctttaccgtaacttcccggtttacccccg

SEQ ID NO: 304026 - DNA, 432 bp, Homo sapiens
  misc_feature: GZ8MTXP02I0S11.44.2.A02.1.454.CMB.2.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (422)..(432): a, c, t, g, unknown or other
  misc_feature (422)..(432): n is a, c, g, or t
tcagacagtatatacacgaccggtgctcgatttagactcatctacaagggaaagggccaccctctcctgcagggccagtcagagtgtttccagtaactccttagcctggtaccagcagaaacctggccaggctcccaggctcctcatctatggtgcatccagcagggccactggcattccagacaggttcagtggcggtgggtctgggacagacttcactctcaccatcaccagactggancctgaagtattttgctactgtatttctgtcaccagtatgctagcccatactcgttttggccaggggaccaagcctagggagatacaaacgtacgtagtggctgcacattctgttccttnacttccttcccgcctatctgtattatatactgtctgacgcggctggacaacggcgcgatagnnnnnnnnnnn

SEQ ID NO: 304027 - DNA, 679 bp, Homo sapiens
  misc_feature: GZ8MTXP02HBDP6.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacgggccacatcacctgcaagtccagccacaaccttggatacgaggtaccaacgttgaagtaattacttggttaggtatacaaacaggaaggcaaggacaggtccctaccgttaggttcctctaagtttacgggactatccgagggccgggcacggtcccggggtccctggacctattccccaggccgcccagggtccgggtcgtggggacacggtacttccgacctaccgtcaacccgactaccgaaaccggtcccgtggaccgtaaggggtagaaagtacgttacgttcgaacctaaactttacttaacctacgttaccaaggtacctaagtttacgttttaacggaaaaccggttccccgttacgtacggtttcgggggaccgggggaaccgtaggggtaccggaaacgtcgaacggtaaccgtaacgtcggtacggactcggaccaaccgtctcgttacgttccttctacgttccctttccccg

SEQ ID NO: 304028 - DNA, 654 bp, Homo sapiens
  misc_feature: GZ8MTXP02F3DD9.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtcccccagacctccctggctgtgtctcgtggggcgaggacgggccaccatccacctgaccaagtccagcccacaaccttggatacaggtccaacgttgagtaattacttggttagatcaaacagaaggcaggacagcctctaggttcctcagtttacggacagtccgaggcgggcacggttcccgggtaccctggaacccgtattccccgacgccgaccgacgggtccgggtctaggggacacgtacgttccggacctacctaccacctactacccgaaaccgggtccctaggaccgtaggggttacgaaagtacttcgttacgaccttaaaacgtttattaccgtgttaccgaaggtcctaaggtttacgtttaggaaacccggtccccttagtaccggtttcgggggacggggtacctagggggtacgaaacgtcgaggaccgtacgtcgtacgacctgaccaacgtactcgttacgtccttcgtactttcccgac

SEQ ID NO: 304029 - DNA, 682 bp, Homo sapiens
  misc_feature: GZ8MTXP02IIH1X.44.2.A02.1.454.CMB.2.raw
  modified_base (654)..(654): a, c, t, g, unknown or other
  misc_feature (654)..(654): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgaggacggccaccatccacctgacaagtccagcccaacaaccgttggaatacgaggtaccaacgttgaagtaattacgttggttgatacaaacgaggaaggcaaggacacgtcctccgtaggttcctctaagttacgggactacgtccgagggcggcacggtcccgggcctaggaccgtatcccgagccgtcgaggccgggtcagggacacggtacttccggacctactcaaacctagtaccgaacccggccgtaggaccgaagggggtacgtaaaggtcgttacgttacgaacttaaacgtttaacgttacttacgtaccgttaagtaccgtaaagttttacgtttaaacggaaacccggttccccttaacggtacccggtttacgggggaccgggggtaaccgtacgggggtaacgtaacgtacggtacggaaacgtacgttcggtacggctacgacgaacctntaccgtcgtacttcactttccctacccg

SEQ ID NO: 304030 - DNA, 622 bp, Homo sapiens
  misc_feature: GZ8MTXP02F779Z.44.2.A02.1.454.CMB.2.raw
  modified_base (310)..(310): a, c, t, g, unknown or other
  misc_feature (310)..(310): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagacggccacatcacctgcaagtccacgccacaaccttggatacgaggtaccaacggttgaagtaatttacgttggtttgtatacaaacaggaaggcaggacacgccctcgttaggttcctntacgtttacgggacagtccgaggccgggctacggtcccggggtaccctggaccctagtcccgacggccgccgaggtccgggtcgtacggggacacgtaccttcgaccacctcaaccgactaccgaaccggcctagcgagggtgaacgcttacgtacgactaaacgttattacgtagtacagctagttatttacggaaaccgtccctagtccggtttacggggacgggggtacgtacggggtacgtaacgtcgagtaaccgtaagtcggtacggctcgacaacctacgtctcgttactactactccctacccg

SEQ ID NO: 304031 - DNA, 778 bp, Homo sapiens
  misc_feature: GZ8MTXP02GALDP.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacggccaccatcacctgaccaagtccagcccaacaaccttggactacaggtaccaacgttgaagtaatttacgttggttaggtatacaaactaggaaaggcaggacagccctccgtaacggttcctactacgtttacgggactacgtccgagggccgggacacggttcccggggtccctaggaccgtattccgacgtccgccgtacgggcgggtccgtaggggaccagtaccgttcggacctaccttaccgaacctactacccgaaacccggtcccttacgggacggtaacgggggtacgaaacggtacgttaccgttacggtaaccttaaaaccgtttaacgtttaaaccgttacggttaccgtaacggtaccgttaaacggttttaaacgtttttaacgggaaaacccggttcccccgtttaacggttaacccggggttttaccgggggaccggggggttaaacccgtacgggggttaacgggtaaaaccgtacggaacggtaaaccggtaaaccgttggggtaccggtcgttacggaccaaccgtacgttcgtacggttccttacgtacttcccgtttaccccg

SEQ ID NO: 304032 - DNA, 688 bp, Homo sapiens
  misc_feature: GZ8MTXP02GA2L9.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctcgacccacgtccccagacctccctggctgtgtctcgtgggcgagacggccacatcacctgacaacgtccagccaactaaccgttggaactacgaggtacctaacgttgaagtaatttcgttggttagtatacgaaacgaggaacggcaaggacacgtccttccgtaacggttcctacgtacgtttaaccgggacacgtccggagggccgggtactaccggttccccggggtcctaggacccgtattcccgacgtccgacgacgggtccggtcgtacggggaccacgtaccgttcggacctaccgtaccaaccgtactaccgaaaccggtccctaggaccggtagggtagaaacgtcttacgtacgaccttaaaactttagttaaccgtgtacacgttacttaagtttaacgtttaacggaaacccggtcccttaggttaccgggttacggggaccggggtaacgaggggtacgaactcggaagtaacgacggttgacgtcacgtaccgaacgtcgtctcgtacctactacctccgtccc

SEQ ID NO: 304033 - DNA, 671 bp, Homo sapiens
  misc_feature: GZ8MTXP02HB5XN.44.2.A02.1.454.CMB.2.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccagtccccagacctccctggctgtgtctgtgggcgagacggccacatccacctgcaagtccagccacaaccttgactacacggtaccaacgttgaagtaattacgtttggttaggtatacaaacgagaacggcaaggacacgtccctacgtcgttcctactagttacggacacgtccgaggccgggctacggtcccggggtacctggaccgtatccccgagccgccgaggtcggtcgngggacncgtactcgacactacacancgacgccngacgaggagaagtctacgtacgtactaaacgttacttacgtcgtacgtacgtagttaaggtttacgtttaacggaaacccgttccccgttaacggttacccggggtttccgggggaacccgggggtacgtaacgggggtaaccggtaaccgtaaccgggacggtaaaccggtaacggtcggtacgggtaacctccggacctaaccgtacttaccgtcggttccttacctaccgtttcccgtccccg

SEQ ID NO: 304034 - DNA, 574 bp, Homo sapiens
  misc_feature: GZ8MTXP02FS1HV.44.2.A02.1.454.CMB.2.raw
  modified_base (327)..(327): a, c, t, g, unknown or other
  misc_feature (327)..(327): n is a, c, g, or t
  modified_base (359)..(359): a, c, t, g, unknown or other
  misc_feature (359)..(359): n is a, c, g, or t
tcagacagtatatacacgaccggtgctcgatttagactcatctacaggggccacaacaggcaggcaggggcagcaagatggcgctgcagacccaggtcttcatttctctgttgctctggatctctggagcctacggggacatcgtgctgacccagtccccagacctccctggctgtgtctctggcgagaggccacatcacctgcaagtccagccacaaccttggatacaggtccaacgttgagaattactggttgtatcaacagaaaggcaggacagcctcctaggttcctcatttacggacatccaggcggcagtcccggggtccngaccgattcccagcgccgagcgggtctgggcngactcgcactcaccatcaacgcctgcgaggtgaagatcttgactaacttattactagtcagctagttactttagaaacgtccccttactaccgtttacgggaccgggggtaccgaacggggttacgggaaaccttacgaaggaccgtaaacgttcggttacggactcggaccaaccgaacttccgtcgttcctttactacgttcctttacccccg

SEQ ID NO: 304035 - DNA, 616 bp, Homo sapiens
  misc_feature: GZ8MTXP02GR95P.44.2.A02.1.454.CMB.2.raw
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtgggcgagaggccaccatcactgcaagtccagccacaaccttggatacaggtccaacgttgagaatttacgttggttagatcaaagagaaggcaggacaggccctccgttaggttcctcgtaagtttaccgggaactacgtaccgagggccggggtacacggttccccggggtcccctaggaaccccgtattcccgacgccgccgaggccggtcgngggacncggtacttcgacacgtccacagtaccgaacggcctaggacgtagggtaacgaagacttcgtagacctaaacttattaccgtgtacagactattagttacgaacgtccctacgtacggtttcggggacgggaccgagggtacgaacttcgaagacgacggttcggacgccgtagacctaacgtcgttccttcgtccttcgacttcccgtcccg

SEQ ID NO: 304036 - DNA, 702 bp, Homo sapiens
  misc_feature: GZ8MTXP02H5Z7S.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccagtccccagacctccctggctgtcgtctcgtgggcgaggacgggccaccatccacctgcaagtccagccacaaccttggactacgaggtccaacgttgaagtaacttacgttgggttagtactacgaaacaggtaaggcaggacacgtccctaccgttaggttcctgtagtttaaccggggacagtcccggagggccgggctacggtccccggggtcctacgaccgtatccgacgtccgcgaggtccggtcgtaggggacacgtacttccgactaaccgtccaaaccgtactaccgaacggccgtacgaccgaaggggtacgaaacggtacttacgttacgaaccttaactttattaaccgtgttaccgaagtacgtaagtttacgttttacgaaaccgttcccttacggttaaccggttccggggtaaccgggggtacgtacggggtaccgtaacgtacgaaacggtacggtaacgtacggtacggtaccgtcgaccgtaaccgtacgttacgttacggttccttacgtacctttacccgtccccg

SEQ ID NO: 304037 - DNA, 575 bp, Homo sapiens
  misc_feature: GZ8MTXP02IYR95.44.2.A02.1.454.CMB.2.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (491)..(491): a, c, t, g, unknown or other
  misc_feature (491)..(491): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagacctccctggctgtgtctcgtgggcgagacgggccaccatcacctgcaagtccagccacaaccttggatacnggtccaagttgaagtaattacttggttgtatcaaangaagcaggacagcctctaggttcctnaagtttcggacatccgagggccggctagtcccggggtcctggacctattccagccgcacggcggtctagggcnggtaccttcgcacctcaccatcacgcctgcgagggtgaagtactcgttagactaacttattactgtacagtctagttagtttacgaaacgtccctacgtacggtttcgggcggggtaacgngggtacgtaacgtacgacggaaccgtaacgtcggtcggtactcggactaacgacttcgtcgtcgttctacgttccctttacccg

SEQ ID NO: 304038 - DNA, 825 bp, Homo sapiens
  misc_feature: GZ8MTXP02JV916.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccacgtccccagacctccctggctgtgtctcgtgggcgaggacgggccacatccacctgacaagtccacgccaactaaccttggactacgacggtaccaacggttgaagtaatttacgttggtttagtatacaaacgaggaacggcaggacagtcctaccgtaggttcctacgtagttaacggactacgtccgagggcgggactacggtcccggggtacctacggaccgtatcccgagccgaccgacggggtcggggtcgtacggggacctacggtaccgttccggacctacctacccgaccctaacgtacccgaaacccgggtcccgtaggaccggtaagggggttaacgaaaggtaccttcgtttaacggaacctttaaaaccgtttaactttaccggttacgttaccgtaaacggtaccgttaaagttttaaacggttttaaccggtaaaacccggttccccccgtttaacgggttaaacccggggttttcccggggggacccggggggttaaaccggtaaacggggggttaaccggtaaaccggtttaaacccggaaaggggttaaacccgggttaaaacgttcgggtacgggtaccgttcggaacccttaacccgtacgttccggttaccggttacctttaccggttacctttccccgtttaccccg

SEQ ID NO: 304039 - DNA, 761 bp, Homo sapiens
  misc_feature: GZ8MTXP02JX3A2.44.2.A02.1.454.CMB.2.raw
tcagacagtatatacacgaccggtgctcgatttagactcatctacagggggccacaacaggcaggcaggggcagcaagatggcgctgcagacccaggtcttcatttctctgttgctctggatctctggagccgtacggggacatcgtgctgacccagtccccagacctccctggctgtcgtctcgtggcgagacggccacatcacctgcaacgtccagccacaacttggatacgaggtccaagtgagtaattacgttggttgtatacaacagaaggcaggacagcctctagttcctctagttacggactactcgacgggcggactacgtcccggggtcctacggaccgtattcccgacgtccgccgacggtcgggtcgtacgggacaggtaccttccggacaccgtccaaccgtactaccgaaaccggtccgtacggaccggtaagggggtacgaaacggtacttcgttaacggtaaccttaaactttaacgtttaaaccgtcgttaccgaggttaccgttaaaggtttaacggttttaacggaaaaccccggttcccccgtttaacggttaacccggggttttacggggggacccgggggttaacccggtagggggtttaaccggtaaaccgttaccggaaacgggtacccgggtaaaaccggttcggtacgggttaaccgccggtacccgtaaaaccgttcgtttaccccggttggtttaaccccgttcgttaacccctttacccgggtttaccccccg

SEQ ID NO: 304040 - DNA, 704 bp, Homo sapiens
  misc_feature: GZ8MTXP02HI32W.44.2.A02.1.454.CMB.2.raw
  modified_base (398)..(398): a, c, t, g, unknown or other
  misc_feature (398)..(398): n is a, c, g, or t
tcagacagtatatacacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactcctggctgtgtctcgtgggcgagaggccaccatcacctgcaacgtccagccacaacttgatacaggtccaagttgaacgtaattacgttggtttagtactacaaacgagaacggctaaggacacgtcccttacgtacggttcctactagtttaccgggacataccgagggtcgggactacggtccccggggtcctaggaccgtattcccgaacgccgacgaggccgggttcnggggtaccagtaccttcgaccactccaaacccgataccgaaccggtccagacgagggtacgaaagacgtacttacgacttaaactttacgttacctacgtacacggtacttaaggtttaacgttttacggaaaaccggtccccttaaccggttaacccggtttaccgggggaccggggggtaacccgtaagggggttacggtaaaccggttacggaaacggtaaccggtaaacggtcgggttacggaccgttcggaaccgaaccgtaacttcgttacggtccttacttacgttaccctttaccccg

SEQ ID NO: 304041 - DNA, 553 bp, Homo sapiens
  misc_feature: GZ8MTXP01CUXPV.25.16.B05.1.454.CMB.2.raw
  modified_base (413)..(413): a, c, t, g, unknown or other
  misc_feature (413)..(413): n is a, c, g, or t
  modified_base (538)..(538): a, c, t, g, unknown or other
  misc_feature (538)..(538): n is a, c, g, or t
  modified_base (543)..(553): a, c, t, g, unknown or other
  misc_feature (543)..(553): n is a, c, g, or t
tcagactgtacagtcacgaccggtgctcgatttagagctcacgtaagggcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgacaaatgaacagtctgagagctgaggacacggtcttgtattactgtagaacaaaaattattaacgttagcagcagctacggtaaaggttcctaatactactactaactacatggacgtcgtggggacaaacgggacctacggtcccaccgtctcctcacgccctcccaacgaaacgggccctatcccggtccttcccccgngcccaccctcctaccaagacgccaccgtcgtcggggcacgcgcgccgtgggctggccgtggtacaacggtctacctcctactacgactagtcgtcggaggccgggcgttgggaccgaaggccganagttnnnnnnnnnnn

SEQ ID NO: 304042 - DNA, 707 bp, Homo sapiens
  misc_feature: GZ8MTXP01C9JP3.25.16.B05.1.454.CMB.2.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (625)..(625): a, c, t, g, unknown or other
  misc_feature (625)..(625): n is a, c, g, or t
tcagactgtacagtcacgaccggtgctcgatttagagctcacgtatttggggtttggggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaactcccnganactctctgtgtgcnctanctcacttnagtagtanggtcttcgtcgtcgggtcccncagtcgtccgaggcgaaggggctggagtggcgttggggtattcgttggtctaggacaagaaccaaatgaactatacgtaccgacggcgggtacgtcccgggtagggacgggggccctattaccgaacctacgttccgtaccggaacgggtaacctaaacgtttaacccgaaaggtaacctaaccccttactaactacctagaaactaaacgtacggtaaaactacgtttaaggaacggttaaggtaccggtaaggtacgtttaacccgggttacgtttttaacgtaccgttcggtccgaaccgtacccgttaggaagggngtacgggacgttaaagggttaaaacggttcgttaacgttacctcgttaccgttcccggttcgtaaccgttcggtaaccgggg

SEQ ID NO: 304043 - DNA, 762 bp, Homo sapiens
  misc_feature: GZ8MTXP02H7UR1.25.16.B05.1.454.CMB.2.raw
tcagactgtacagtcacgaccggtgctcgatttagagctcacgtaagggcacctttgatgattatgccatgcactgggtccggcaagctccagggaaggcctggagtgggtctcaggtattagttggaatagtggtagcataggctatgcggactctgtgaagggccgattcaccatctccagagacaacgccaagaacctcctgtatctgacaaatgaacagtctgagagctgaggacacggccttgtattactgtgactaaaaattattaacgttagcagcagcgtcggaaaggttccttacactaactactactacatgggacgtcgtggggactaaacggggacctacgggttacccaacccggttcctacctaccgacggaccccttaccgacccgtaaacgggggtccccctaacgttcccgggttacccttcccccccggttagggcccctaaccccccgttacctaaccccgtaaacggtaccgaccctaacccgtttacccggtacggggggacccaaaccggaaccgggccccgggtaccccgtacgggggtaccccttacgggtcccccgtttaggggtaccctaaaacgggggtaccccttaaaaccgtttccccgtaaacgttcgggttaaaccgtaaccggttcccgtttagggaaaccggggtccgggggaaccggtttcgggaacggttaaaccgggggtccctacgaacgttaacggacgtaacgacgacgacacgacgacgcgc

SEQ ID NO: 304044 - DNA, 574 bp, Homo sapiens
  misc_feature: GZ8MTXP02HOI52.25.16.B05.1.454.CMB.2.raw
  modified_base (401)..(401): a, c, t, g, unknown or other
  misc_feature (401)..(401): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(571): a, c, t, g, unknown or other
  misc_feature (569)..(571): n is a, c, g, or t
  modified_base (573)..(574): a, c, t, g, unknown or other
  misc_feature (573)..(574): n is a, c, g, or t
tcagactgtacagtcacgaccggtgctcgatttagagctcacgtaagggcacctttgatgattatgccatgcactgggtccggcaagctccagggaagggcctggagtgggtctcaggtattagttggaatagtggtagcataggctatgcggactctgtgaagggccgattcaccatctccatagacaacgccaaagaactccctgtatctgcaaaatgaacagtctgagagctggaggacacggccttgtattactgtgacaaaaattattacgttagcagcagctacggtaaaggttccttactactactactactacatggacgtgtggggacaaagggccacggtcccaccgtctcctcagccctcaccgaagggcccatccggtccttcccccgngcccaccctcctcccaagacgctacccgtcgtcgggggcacgacgccggcccgtcggggctcggcccgttgggtaccaacgggtaccttaccgttccaacttcgtactagttcgtcggacggtccggggcgttcgggacgaacgggcgaccgacgtacgngngncncnnncnn

SEQ ID NO: 304045 - DNA, 584 bp, Homo sapiens
  misc_feature: GZ8MTXP02FOHZ0.25.16.B05.1.454.CMB.2.raw
  modified_base (532)..(532): a, c, t, g, unknown or other
  misc_feature (532)..(532): n is a, c, g, or t
  modified_base (572)..(572): a, c, t, g, unknown or other
  misc_feature (572)..(572): n is a, c, g, or t
  modified_base (575)..(584): a, c, t, g, unknown or other
  misc_feature (575)..(584): n is a, c, g, or t
tcagactgtacagtcacgaccggtgctcgatttagagctcacgtaagggcacctttgatgattatgccatgcactgggtccggcaagctccagggaagggcctggagtgggtctcaggtattagttggaatagtggtagcataggctatgccgactctgtgaagggccgattcaccatctccagagacaacgccaagaacctccctgtatctgacaaatgaacagtctgagagctgaggacacggcttgtattactgtagactaaaaattatacgtagcagcagctacggaaaggttcctactactactactactacatggactcgtggggacaaagggaccacggtaccacccgtctcctcacgcccttaccacccgaagggccccattcccgggtccctttccccccgtggcccccacccctccctacccaaacgacgacctacccgtcgtcgggggcacgacgccggcccgtggggcctaggcccgtgggtaccaaacgggtaccttaacccgttccgacctgtaacgngtacgtggaacggtcggggcctgggacaacgggcgacaanagnnnnnnnnnn

SEQ ID NO: 304046 - DNA, 565 bp, Homo sapiens
  misc_feature: GZ8MTXP02G2JQ0.25.16.B05.1.454.CMB.2.raw
  modified_base (556)..(565): a, c, t, g, unknown or other
  misc_feature (556)..(565): n is a, c, g, or t
tcagactgtacagtcacgaccggtgctcgatttagagctcacgtaagggcacctttgatgattatgccatgcactgggtccggcaagctccagggaagggcctggagtgggtctcaggtattagttggaatagtggtagcataggctatgcggactctgtgaagggccattcaccatctccagagacaacgccaagaactccctgtatctgacaaatgaacagtctgagagctgaggacacggtccttgtattactgtagaactaaaaatttattacgttagcagcagcgtaggtaaacggttccttaactactaactactactacagtcggacgtgaggggacaaagggccacggtcccaccgtctcctacgacgtccctccaccgaacgggtccctacgtcccggttcccttacccccgtggccctacccctctaccagacgccaccgtcgcggggcacgacgccgccgtgggctcgccgtgtacaacgggtaccttaccgtccattcgaacgtcgtcgtaggcggtcggtcagggacccaaagggcacgagannnnnnnnnn

SEQ ID NO: 304047 - DNA, 577 bp, Homo sapiens
  misc_feature: GZ8MTXP01D0Y4L.4.36.D03.1.454.CMB.2.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactcttcngctatnatgctagaagagcagtcacgggtntntgtnttgtgtgcgtcggtacttccgaccgacgacgtgacggtggtacgtaggtatgtatctatagttgtacgtggtacggtacgggacgaacggtaactacgtcgtacctaccgtctaccgtaccgaccgacctacccaaccgtacgtacctacgttccgtacccttacccgtacgaccgtaccgtacgacgaccgacggacgacccgaccggtacgacgtacgacgtacgtcgtcggtcgtcggtcgtcgtccgtcgtacgtaacgtcgttccgtccgagngtcgcgttgngtgcgtgtgcgacgtcgaagtaag

SEQ ID NO: 304048 - DNA, 504 bp, Homo sapiens
  misc_feature: GZ8MTXP01CNNF4.4.36.D03.1.454.CMB.2.raw
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactctttcngcaaatgaacagcctgagagccgaggacacggctatgtatttctgtgctcggatttccnccccgganactgcggtggcagggtatgatgctatttgactatcgtggggccaagggacaatggtcaccgtctctcagctccacaggccatcgtctcccngcncctgcncagngcacgtcgagcgcacngccggccctgggcctgccctgggtcaacggtacttaccgttccccagacggtgcttcgttgaacggcgggctgggcaggcgcgtaag

SEQ ID NO: 304049 - DNA, 474 bp, Homo sapiens
  misc_feature: GZ8MTXP01B4I4T.4.36.D03.1.454.CMB.2.raw
  modified_base (241)..(241): a, c, t, g, unknown or other
  misc_feature (241)..(241): n is a, c, g, or t
  modified_base (462)..(474): a, c, t, g, unknown or other
  misc_feature (462)..(474): n is a, c, g, or t
tcagagcactgtagcacgaccggtgctcgatttagctgcgtcacgatctctcttggggttgtctctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccgganactgcggtggcagggtatgatgcatttgatatcgtggggcccaaaggggacaatggtcaccgtctcttcagcctccaccaagggcccatcggtcccttccccctggccgccctgctcccgaaggcgcaccctccgagacgcacagcggccctgggctgcctggcaaggacctacttccctacagtcgcgtctggacgcggggctgggcaaggtcgcatagnnnnnnnnnnnnn

SEQ ID NO: 304050 - DNA, 589 bp, Homo sapiens
  misc_feature: GZ8MTXP01B9O6R.4.36.D03.1.454.CMB.2.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactctcngctatnatgctagaagngcgagtctacgggtntntgtntgtgtgtcgtcggtacttccgaccgagacgtggtaggtggagtaggtatagtatagtactagttagtacgtagtcggtacgggacgtaacggaactacgtcgtacctaccgtactacgtaccgaccgacctaaccaccgtacgtcctacgtccgtacctacccgtacgtaccgcctacgaccgcgacggacgaccgaccggtacgagacgtacgtacgtcgtccgtcgtggtccgtccgtcgtacgtcgtaacgtccgttccgtccgacgtgtcgacgttcggttgaacggtcggtaacgtggacgttacggtcgttcgtaag

SEQ ID NO: 304051 - DNA, 558 bp, Homo sapiens
  misc_feature: GZ8MTXP01EG5K4.4.36.D03.1.454.CMB.2.raw
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactctttctgacaaatgaacagcctgagagccgaggacacggctatgtatttctgtgctcggatttccnccccganactgcggtggcagggtatgatgctatttgatatcgtggggaccaagggacaagtggtcaccgtctctttacgcctccaacgacggcccagtccggtccttccccgnggccgccctgccnccgacggcncaccgtccggagcgcgacgacgcccggcccgtgggcctcgtccgtacgggtaccaacgggtaaccttaaccgttcccgtaccaggtcgccttcggcggacggcgggtcgtcgggacgacggcgaacgaagtg

SEQ ID NO: 304052 - DNA, 701 bp, Homo sapiens
  misc_feature: GZ8MTXP01BQVKL.4.36.D03.1.454.CMB.2.raw
  modified_base (300)..(300): a, c, t, g, unknown or other
  misc_feature (300)..(300): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgcaaatgaacagcctgagagccgaggacacggctatgtattctgtgctcgggtatttccgtccccgganacgtgcggtggcgagggtatgatgctatttgatatcgtgggggacccaaaggggtactaaagtttcggtcctaacccggttcttcctttaccgaacggtccccttaccccgaacccgtaaacggggccccctaacgttcccgggttcccctttcccccccgttcgggccccgtcccccgttcggacccttcccgaagggaaccggtcccaaccccggttacccgggaacgaacgcccgtaaccgacggggccccgggtccccgttcgggggcccttccgggccccgttggggtacccaaaacggggtacccttaacccgtttaccccttaaccgtaaggtcggttccgttccgttagggaacggccgggggcctggggaccgaacgggtccggaacgtaag

SEQ ID NO: 304053 - DNA, 620 bp, Homo sapiens
  misc_feature: GZ8MTXP01AITHM.4.36.D03.1.454.CMB.2.raw
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactctcagctagtcattgctagaagagtcgagttctgggtntntntntgtgtgtcgtcgtctcgcgancgtgngtgagtagtctagtatagtatagtagtacgtgtggacggtacgtacgaactacgtcgtactaccgtactaccgtaccgacgacctaaccctaccgtacgtacctacgttaccgtaccttaccgtacgtaccgtaccgtacgaccgaccgacggtacgaccgtaccgggcggtacgtacgtacgtacgtcgtcggtccgttacggtccgttccggtacccgtccggtcccgtaacggtccgttaccggttcccggaggtacggtcgttcgttcggttacggaacggttacggtcgttacggtacggttacggtcggttaacgtaacg

SEQ ID NO: 304054 - DNA, 576 bp, Homo sapiens
  misc_feature: GZ8MTXP01EL9SL.4.36.D03.1.454.CMB.2.raw
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcgacgggaccccccaggctggaccaagccctccccagactccaccaatcgcccctcacactggacaccttactaaaatagacaaacaaaggaaaaccccagctacacgaccccaattccattggtgacgtcctctgtgctcagtgctgatcaaccagtaggaaaggcttgggacgtccgaggggctaaggctcctctctgacgacctccaaccgaacggggccccaggttccggtccctttcccccgngggcccncccgtgcctccgaggcgccaccgtccgaagcgcacgcgccggcccttggggccttcggcctgggtcaacgggtccttaccgttcccttaacgtcgg

SEQ ID NO: 304055 - DNA, 598 bp, Homo sapiens
  misc_feature: GZ8MTXP01EJ203.4.36.D03.1.454.CMB.2.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccattcaccatctccagagaccaaaccccaagaactcactctttcngcaaatgaaacngcctgaagagccgaggacacggctagtgtatttcgtgtgcgtcgggtatttccgccccggacaccgtggacggtggcgtagggttatggattgctagtttgattacgtcggtaggggacccaaaggggaaccaagtgggtcctaacccggttctccgttacacgtcccctacccaaccgaacgggtccctacgtccggttcccttccccgtggccctcccgtcgcctccgaggacgccaaccggtcgagacgcaacgcgccggcccgtgggcctggcctggtaccaagggtccttaccgtcccttagcgtcgccgttcgagggcggcgggtcgtggacgaacggggccttgaag

SEQ ID NO: 304056 - DNA, 560 bp, Homo sapiens
  misc_feature: GZ8MTXP01DYTBJ.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcacgggaccccccaggctggaccaagccctccccagactccaccaatcgcccctcacactggacaccttactaaaatagacaaacaaggaaaaccccagctacacgccccaaattccaatggtgagtcctcctgtgctcagtgctgatcaccagtggaaagcttgagtcagggctaaggctctctctgacgacctccaaccgaacgggccccaggtcccggttccttcccccgtggcccgccccgtgccctcccgaggtacgcccaccgtcccgaagcgcacgacgccggcccgttgggcttcgcctgggtcaaggccttacttcccgaacgtcg

SEQ ID NO: 304057 - DNA, 547 bp, Homo sapiens
  misc_feature: GZ8MTXP01DC73H.4.36.D03.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (404)..(404): a, c, t, g, unknown or other
  misc_feature (404)..(404): n is a, c, g, or t
  modified_base (445)..(445): a, c, t, g, unknown or other
  misc_feature (445)..(445): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaaccccaagaactcactcttctgcaaatgaacagcctgagagccgaggacacggctatgtatttctgtgctcgggatttcctccccgganacgtgcggtggcagggtangatgcatttgatatcgtggggaccaaggggaacaagtcggtcaccgtctctcacgcctccaccaaggcccagtcggtccttccccnggccgccctcgctccgaggacgccaccgtccgagacgcacncgccggcccgtgggcctcgccgtggtaccaaacggtaccttaccgttccccttacgtacgttcgcttcgttggaacggcgggctcgggcgaacggcgctaag

SEQ ID NO: 304058 - DNA, 572 bp, Homo sapiens
  misc_feature: GZ8MTXP01AUS5A.4.36.D03.1.454.CMB.2.raw
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (389)..(389): a, c, t, g, unknown or other
  misc_feature (389)..(389): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctcaggctagttcattgcagaaagagtgagttctgggtntntntntgtgtggtgtggtagtcgtacgcgagngacgtgtgtagagtacgatatcgtagtctatgtagtggacgtacggtacacgtcgcctacgacgactaccaacgacgtaccacacgtacctntcgtactacgtagacactgaccgagacggacgacgacggaccggtagagtaccgttaagttgttaccggtcgttacgggtccgttacgtcccgtaccgggtcctaaccggtcgttacggtcccgttaggtacgtggacgttgttagtaagtcgtcgttgaccggttaggtcggaacggtaacg

SEQ ID NO: 304059 - DNA, 556 bp, Homo sapiens
  misc_feature: GZ8MTXP01DS4H7.4.36.D03.1.454.CMB.2.raw
  modified_base (300)..(300): a, c, t, g, unknown or other
  misc_feature (300)..(300): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaaccccaagaactcactctttctgcaaatgaacagcctgagagccgaaggacacggctatgtatttctgtgctcgggatttcgccccgganacgtgcggtggcagggtatgatgcatttgatatcgtggggaccaagggaacaagtggtcaccgtctctcagcctaccaccaacgggcccagtcggtccttccccgtggccgccctcgcctccgacggacgccaccgttccgagacgcgacgacgccggcccgtgggcctcgccgtcgggccaaacggtcttaccgttaccccttacgtacggtcgcgttcgttggaacggcgggtcgtcggcgaaggtcgcgtaag

SEQ ID NO: 304060 - DNA, 560 bp, Homo sapiens
  misc_feature: GZ8MTXP01CZL93.4.36.D03.1.454.CMB.2.raw
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcacgggaccccccaggctggaccaagcctccccagactccacaatcgccctcacactggacaccttactaaaatagacaaacaaacggaaaaccccagactacacgccccaaatccatggtgagtcctctgtgctcagtgctgatcaaccaagtggaaacgcttaggacgtccgagggctaaggctaccgtctctgacgaccctccaaccgaacgggccccagtcccggtcctttcccccgngggcccncccgtgcctccgaggacgcaccgtccgaagacggcacgngccggcccttgggcttcgcctggccaagggcttaccgtccngtaacg

SEQ ID NO: 304061 - DNA, 608 bp, Homo sapiens
  misc_feature: GZ8MTXP01ED230.4.36.D03.1.454.CMB.2.raw
  modified_base (567)..(567): a, c, t, g, unknown or other
  misc_feature (567)..(567): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcagctagtcatgctagaagagtcgaggtctagggtctatgtattcgtggtggcgtcggattcgtcccggacgacgtgacggtggtcgtagggttatcgatagacgtattcgactgtacgtcgggacgtagggtaactacgtcggtactacccgtactacttaccaacgtaccctaccaaccaacggtacctacgtacgtccttaccccgacgtacctacgacgtacacggacgacgaccgtaccggaggacgacgtacgtagtccgtccgttgggcttcgtccgtcgttcgaacggtcctacgttccgtacggttaggtcgtcgttagttcggacggnggtccgttaagtcgtaagggcgtaaccggttaagtaacggg

SEQ ID NO: 304062 - DNA, 538 bp, Homo sapiens
  misc_feature: GZ8MTXP01A0HHM.4.36.D03.1.454.CMB.2.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactcttctgcaaatgaacagcctgagagccgaggacacggctatgtatttctgtgctcgggatttcctccccgganactgcggtgcagggtatgattgctatttgatatcgtggggccaaggggacaagtggtcaccgtntctcacgcctaccacaagggcccatccggtccttccccgnggccncctgcctccaggcncaccgtccggagacgcacgagcggcccgtgggcctggccctggggtccaaagggtccttacgttccccgacgtaggtcgttccttgttcggaacggcgggctgggcaagggcgcgaag

SEQ ID NO: 304063 - DNA, 592 bp, Homo sapiens
  misc_feature: GZ8MTXP01BAL1E.4.36.D03.1.454.CMB.2.raw
  modified_base (306)..(306): a, c, t, g, unknown or other
  misc_feature (306)..(306): n is a, c, g, or t
  modified_base (420)..(420): a, c, t, g, unknown or other
  misc_feature (420)..(420): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcacttctttctgacaaatgaacagcctgagagccgaggacacggctatgtatttctgtgcgtcgggtactttcccgtccccgganacgtggcggtggcgtagggtatgatgctatttgattatcgtggggaccaagggaacaagtcggtcacgtctcttcacgtcctaccacgacggcccagtccggtcccttccccgngcccgtccctgcctccgaggcgccaccggtcgagcgccacgcggccggcccgtggggcctcgcccgttgggtaccaaaacgggtccctttaaccgttccccgttaacgaggttccgccgttcggttacggaacgggccggggtaactcggggaccgaacgggccgaagtaag

SEQ ID NO: 304064 - DNA, 554 bp, Homo sapiens
  misc_feature: GZ8MTXP01DT4VH.4.36.D03.1.454.CMB.2.raw
  modified_base (233)..(233): a, c, t, g, unknown or other
  misc_feature (233)..(233): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcacttctttcngacaaatgaacagcctgagagccgaggacacggctatgtatttcgngtgctcgggatttccgtccccgganacgtggcggtggacagggtatgatgctatttgatagtcgtgggggacccaaagggaactaagtcggtacctacccgttctccttcacgtcccctacccaacccgaacgggccccagttccggtcccttcccccgtggcccgtcccctgccctccgaaggacgccaccggtccgaagcncgaacnggccggccgtggctgccgtgcaagcttacgtccttagngtgcttgngngcggctggcaggcgcaag

SEQ ID NO: 304065 - DNA, 776 bp, Homo sapiens
  misc_feature: GZ8MTXP01AHAGN.4.36.D03.1.454.CMB.2.raw
  modified_base (301)..(301): a, c, t, g, unknown or other
  misc_feature (301)..(301): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgacaaatgaacagcctgagagccgaggacacggctatgtatttctgtgctcgggatttcctcccccgganacgtgcggtggcagggtatggatgctattttgattagtcgtgggggacccaaaggggaaccaaagttcggtcctaaccccggttcttcctttcgacggcccctacccgaacccgaaacggggcccctaacgttcccgggtttcccctttcccccccgtcggggtccccggtccccccttagggccccttacccggaacggggtaccggtaccccaaacccccgggttcccggggaaacggtaaaccggcccgtaaaaccccgacggggtccccgggggcccccggtttcggggggcccgttccgggtaaccccgttcgggggttacccgaaaaacgggggttaccccctttaaacccttttcccccccgaaaccgtacgggttcccggttcccgtttccgttcggggaaccgggggtcccgggggaaccgttcccgggggaccggttaaaacgggggtccccgttaacgtaaagg

SEQ ID NO: 304066 - DNA, 500 bp, Homo sapiens
  misc_feature: GZ8MTXP01CZ5LU.4.36.D03.1.454.CMB.2.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaacttactctttcngcaaatgaacagcctgagngccgaggacacggctatgtattctgtgctcgggatttctccccgganactgcggtggcagggtatgatgcatttgatatcgtggggccaaggggaccaaaatggtcaccgtctcttcagcctcaccaagggcccatcggtctcccctggcnccctgctccgagcgcacctcggganagcacagcggcccngggctgcctggtcaaggccttcttccctantgcttcngcgcgggctggcaggcgcngtg

SEQ ID NO: 304067 - DNA, 592 bp, Homo sapiens
  misc_feature: GZ8MTXP01CMPC1.4.36.D03.1.454.CMB.2.raw
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactctttctgacaaatgaacagcctgagagccgaggacacggctatgtatttctgtgcgtcgggtactttccgcccccgganacgtggcggtggcgtaggggtatggatgctatttgattagtcgtagggggaccaaaggggaacaagtcggtcctaccgtcttcgtcacgccctacccaccgaacgggcccagtccggtccttccccgnggccgccctgcctccgaggcgccaccgtcgagacgcacgacgccggtcccgtggggcctcggcccgtcgggtaccaaacgggtcccttaacccgttccccaagtacggtcgccgttcgcggaacgggccgggtcgtcgggacgaacgggcccgttaagaag

SEQ ID NO: 304068 - DNA, 527 bp, Homo sapiens
  misc_feature: GZ8MTXP01AOBT1.4.36.D03.1.454.CMB.2.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttcngcaaatgaacagcctgagagccgaggacacggctatgtatttcngtgctcgggatttcctccccgganacgtgcggtggcagggtntggatgctatttgatatgtggggccaagggtaacaagtggtcaccgtntctcagcctcaccaagggcccagtccggtctcccccgtggccgccctgcctcgaggcgccaccgtccgaggacgccaacgcgccggcccgtggggcctgcccgtggtcaacggacttaccttcccacgngtcncgttcaggngcggctggccagggcgcaag

SEQ ID NO: 304069 - DNA, 596 bp, Homo sapiens
  misc_feature: GZ8MTXP01CQK74.4.36.D03.1.454.CMB.2.raw
  modified_base (263)..(263): a, c, t, g, unknown or other
  misc_feature (263)..(263): n is a, c, g, or t
tcagagcactgtagcacgaccggtgctcgatttagctgcgtcacgatctctcctgtgtagcctctggattcacctttgacacctattggatgacctgggtccgccagtctccagggagggctggagtgggtggccaacattcggcgagatggaattgtgacacactatatggactctgtggaggccgattcaccatctccagagacaacccaagaactcactctcagctagtcattgcagaagagtcgaagttctaggggttntgtgtgtgtgtggtgtacgtacgtcgacgagtagtgagtagtagtagtatagtatgtagtatagtcgtgtaggtcgtacgtacgtaacgtactcgtaccgtacgtacgtacaccgaccaacctaccacgtacgtacctacgtacgtactacgtacgtacgtacgtacgacgacgacggaccgacgtacgggtacggtacgtacgttacgtacgttacgtcgtacggttcggtacgttccgtccgttccggtcgtcgtcggttcggtcgacggtacggtcgttacgttcggttacgtgtcgttcgtgtacgttacggtaacgttaacggtaacg

SEQ ID NO: 304070 - DNA, 753 bp, Homo sapiens
  misc_feature: GZ8MTXP01AMH8C.4.36.D03.1.454.CMB.2.raw
tcagagcactgtagcacgaccggtgctcgatttagctgcgtcacgatctctcttggggttgtctctggagatggtgaatcggcctccacagagtccatatagtgtgtcacaattccatctcgccgaatgttggccacccactccacgccccttccctggagactggcggaccaggtcatccaataggtgtacaaaggtgaatccagaggctacacaggagagtctcgacgggacccccaggctggaccaacgccctccccagacctccacatcgccctcacactcggacaccttactaaaatagacaaacgaacggaaacccagcctacacgacccctaattccatggtacacgtcctctgtcgctcagtcgctgactcgaaccgaggtagggaaacggtccgttagggacgttaccgaacggggtacctaagggcccttaccgtaccgtacgtacgggaacccgtaaccccgtacccgtaaacccggaaaccgggggtccccctaaacggggtttccccggggttaccccctttccccccgggaggggccccctcccccggttcggaccccgttacccggaacggggtaccgaccccgtaacccgggttcccggaaggaacccgcccggaaaccggttaccggggccccggggtccccggtttcgggggccccttacggggaaccccggtttcggggtaacccggtaacgggtaccccgtttaccccttccccgttaaaccggttcccgggg

SEQ ID NO: 304071 - DNA, 742 bp, Homo sapiens
  misc_feature: GZ8MTXP01CF1M1.4.36.D03.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
tcagagcactgtagcacgaccggtgctcgatttagctgcgtcacgatctctcctgtgtagcctctggattcacctttgacacctattggatgacctgggtccgccagtctccgagggaagggctggagtgggtggccaacattcggcgagatggaattgtgacacactatatggactctgtggaggccattcacatctccagacgacaacccaagactcactcttcngcaatgaactgcctgagagccgagacacggtctatgtatttcgngtgtcgtcgggtactttccgtaccccggatacgtggcggtggacgtagggttatagtattgacttagttttgaacttacgtcggtacggggacccgaaaggggtaacctaaaggtcggtaccctacccggttcttccgtaccgacgtacccctacccgaacccggtaacgggtccccttacggttccccggttacccttccccccggtaggccccgtccctcggccctaccgaacggtaccgacccgtaacccgggtccgaacggccgccgaacggtcccggtcccgggtcccgttcgggggtcctccggggtacccgttacgggtaacccggtaaaccgggttacccctttaccgttacccccgttaacggttaccggttcggttccccggttaacgggttcggggtaacccgggaccgggggtccgttaacgggggacccggttaaacggggtcccgttaacggtaagg

SEQ ID NO: 304072 - DNA, 627 bp, Homo sapiens
  misc_feature: GZ8MTXP01BZI6O.4.36.D03.1.454.CMB.2.raw
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (433)..(433): a, c, t, g, unknown or other
  misc_feature (433)..(433): n is a, c, g, or t
  modified_base (470)..(470): a, c, t, g, unknown or other
  misc_feature (470)..(470): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctggtggagggccgattcaccatctccaganaccaaccccaagaactcactcttcngcaatnatgcngagagcgaggtacncgggctatgtatttcgtgtgcgtcggtatttccgtccccgganacgtggacggtggcgagggtntagatgctagtttgacttagtcgtggggaccgaaggggaacaagtcgtaccaccgttctccgttacacgccctaccaccgaacggccctagtccgtcttccccgtaggccncccttgccgcgacggacacccgacggtccgaggtacnccgacgtacggccgggttcccgtggggtcctccgggtccgttacgggtaccgtaaaccgggtaccgttaccccgttacccgttaacggtcggttcgacccgtttgaacgggtcgggtaccgggtcgttagggcccggaaaggtccgaacgggtaacg

SEQ ID NO: 304073 - DNA, 694 bp, Homo sapiens
  misc_feature: GZ8MTXP01C8JSY.4.36.D03.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaacccaagactcactcttcngcaatgaactgctgaagngcgagacacggtntatgtattcgtgtgcgtcgggtactttccgccccgganacgtggcggtgcgtagggtatgatgctattgattagtcggtgggaccaagggaactaagtcggtaccaccggttctcctaccgacgtccctacccgaaccgtaacggcccctagttcccgttacccttcccccgtaggcccctcccgtcgcccgtaccgacggaccgaccccgaccggtacccggaaggaccgaccgaaccggtaccggtccccgggtcccggttcgggccgttcccgggtacccgttacggggtaaccccgtaaaccggttaccccgtttaccccggttccccgttaaacggttacggttccggttcccgttcgggttaacggggttaaccgggccggggtttaaccgtacggggtaccgttaaacggggtccgaaccgtaaggg

SEQ ID NO: 304074 - DNA, 584 bp, Homo sapiens
  misc_feature: GZ8MTXP01B9GU4.4.36.D03.1.454.CMB.2.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
tcagagcactgtagcacgaccggtgctcgatttagctgcgtcacgatctctcctgtgtagcctctggattcacctttgacacctattggatgacctgggtccgccagtctccgagggaagggctggagtgggtggccaacattcggcgagatggaattgtgacacactatatggactctgtggaggccgattcaccatctccagagaccaaccccaagaactcactcttcngctatnatgcagaagncgagtacngggtntntntgtgtgtgcgtacgtctcgcgatcgtgngtgagtagtatgtatgtatagttagtacgtggtcggtacggtacgacggtaactacgtcgtcctactacgtacaccgacgtacccaccgaaccgtacgtacctacgtaccgttaccgtccgtacgtaccgtactacgacgtacgacggacgaccgacggacgacgtaccgtacgtacgtcgtcgtcggtcggtcgtccggtccgtcgtaccgtaacggtcgttaccgtcgttacggtgtcgttacgttcggttcggaaggtcgtcgtcgtacggttcgtaacgttcgtaagg

SEQ ID NO: 304075 - DNA, 565 bp, Homo sapiens
  misc_feature: GZ8MTXP01DTI82.4.36.D03.1.454.CMB.2.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (469)..(469): a, c, t, g, unknown or other
  misc_feature (469)..(469): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactcttctgcaaatgaacngcctgagagccgaggacacggctatgtatttcngtgctcgggatttccgccccgganactgcggtggcagggtangatgctatttgatatcgtggggccctaaaggggaacaagtcgggtacctaacccggttctccttaccgaacgtccctacccaaccgaacgggcccctagtccggtccttcccccgtggcctccctgcctcccgaggacgccaccgtcgagacncaacgcgcgcccgtgggctgcccgtggtccaaggtccttacgttccccagagtcgcgttcggcggcggtcggcgtcggacgacggtcgaacgtaag

SEQ ID NO: 304076 - DNA, 589 bp, Homo sapiens
  misc_feature: GZ8MTXP01AV4F8.4.36.D03.1.454.CMB.2.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (536)..(536): a, c, t, g, unknown or other
  misc_feature (536)..(536): n is a, c, g, or t
  modified_base (551)..(551): a, c, t, g, unknown or other
  misc_feature (551)..(551): n is a, c, g, or t
  modified_base (588)..(588): a, c, t, g, unknown or other
  misc_feature (588)..(588): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctcagctagtcattgcagaagngtcgagtcngggtntntntgtcgngtgcgtacggacttcgccgagcgtagtacgtggtacgtaggtatacgtatagacgtagttacgacgttagtacggtcgggtacgtacggaactacgtcgtaccacgtacgtacgtaccacgacctaaccgaccctacggtacctacgtacccgttactacccgagtaccgccgtacgacgaccgacggacgaccgacggacggtagacgtcgtacgtcgtacgtccgtggtactcggtccgtcggtcgaacgtcgttcgtaccgnggtacgtgcgttcgngtaacgtggtaactggacgttacggtcgttaacgggng

SEQ ID NO: 304077 - DNA, 639 bp, Homo sapiens
  misc_feature: GZ8MTXP01CP5HW.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcgacgggaccccccaggctggaccaacgccctcccccagactccaccaatcgcccctcacactggacaccttactaaaatagacaaacaaaggaaaaccccagactacacgccccctaatccatggtagacgtcctctgtcgctcagtgctgatcaaccaaggtcggaaacggtcttagggacgtccgaaggggtctaaacgggccttccctacgtcgtacggaacgacccttcccgaaaccgaacggggccccaacggttcccggggttcccttcccccgtcgggcccgtcccctcgccctcccgaggtccgccaccgtccgaagcgcacgacggccggtcccgttcggggccttacggcccgttcgggtaaccgaacgggtacccttacccgttccccgttaacgtaaccgg

SEQ ID NO: 304078 - DNA, 686 bp, Homo sapiens
  misc_feature: GZ8MTXP01EMDCL.4.36.D03.1.454.CMB.2.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngctatnatgcagaagngcgagtctagggtctatgtattcgtaggtggtcgtacggtagttcgtaccccggagtacgtggacggttggtacgaagggttactacgtagttacgacgtagttgtacgtacggttcggtacggggaccgtaacggtaaacctaacgttccggtacaacccggtacctaccgtaccgaacggaccctaacctacccgaacggttccctaaacgtcccgttacctacccgtacgggacctcccgtacgacgaccgacggacgaccgaccgggtcgaacggtacgacgtacgtacggcgttaccggtcggggttctccggtcccgtcgggttaccgaaaccggggtttccttaccgggccccgtttaacggggtacggttcgacgttcgttacgggtcggtacgggttcgtacggtacggttacggtaaccggaacgtaag

SEQ ID NO: 304079 - DNA, 655 bp, Homo sapiens
  misc_feature: GZ8MTXP01BZ2LV.4.36.D03.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgacaaatgaacagcctgagagccgaggacacggctatgtatttcngtgctcgggatttccnccccgganacgtgcggtggcgagggtntgatgctatttgatagtcgtgggggaccaaggggaaccaagttcggtacctacccggttcttccttaccgacgtccccttacccgaacccggaaacggggtccccctacggttcccggttccccgtttccccccgtcgggcccgtcccctcggtcccgtcccgacgggacgcccaaccccggggttcccggaaacggaccgaccgaaccgaccgggcccgggccccgtggggccttcggcccgttcgggtacccaaacgggtacccttaccgtttacccgttacgtagtcgttccgttcgttcggaacggcgggcgtggacgaggtccgaactaag

SEQ ID NO: 304080 - DNA, 602 bp, Homo sapiens
  misc_feature: GZ8MTXP01B2EII.4.36.D03.1.454.CMB.2.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
tcagagcactgtagcacgaccggtgctcgatttagctgcgtcacgatctctcctgtgtagcctctggattcacctttgacacctattggatgacctgggtccgccagtctccgagggagggctggagtgggtgccaacattcggcgagatggaattgtgacacactatatggactcgtgtggaggccgattcaccatcnccagagaccaacccaagactcacttcttcngactaatgaactgcagagngcgagcacggtctatgtattcgtgtgcgtcggtatttccgaccccggancgtggacggtggacgtagggtatgtatcgtctagtttgagttacgtcggtaggggacccgaaggtaaccaagttcggactaccgttctactacaccgcctacccgaccgaacggtccctacgtccgttccttccccgacggcctccgtacgccgtccgagacgacccgtaccgacggtacgacgacgaccgcggccgtccggtcggctcgtccgtacggtaccgtaacggtcttaccttcccgaagtcgtcgttccgttacggttcggaagggtccgggcgttcgggacgacggtcgaacgtaag

SEQ ID NO: 304081 - DNA, 602 bp, Homo sapiens
  misc_feature: GZ8MTXP01DLNBB.4.36.D03.1.454.CMB.2.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaacccaagaactcactctttctgacaaatgaacngcctgagagccgagacacggctatgtatttcngtgctcggatttccgccccgganacgtgcggtgcagggtangatgctatttgactagtcgtgggggaccaaggggaactaagtcggtacctaccgttcttctcgacgtccctacccaccgaacgggccctacgttccggttcccttccccgtcggccctcccgtcgcctaccgacggacgcccgaaccgtccggaacgacgaccgaccgacggcccggcccgttcgggcctcgccgtcggtacgtaaacggtccttaaccgttcccttaacgacgtcgttaccttcgttaggaacggtcgggcgtcgggacgaacgggtcgctaag

SEQ ID NO: 304082 - DNA, 650 bp, Homo sapiens
  misc_feature: GZ8MTXP01C4GMN.4.36.D03.1.454.CMB.2.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (597)..(597): a, c, t, g, unknown or other
  misc_feature (597)..(597): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactctcagctagtcattgcagaagagtcgagtctgggtntatntgtcgtgtggtcgtcgtagtcgaccgagacgtgacggtagtcgtagggtacacgtatagtacgtagttacgtacgttaggtacggtacgggtaccggtaacggtaacctacgttaaccggtacctaacccgtaccgtaaccgtaacccgaaaccggtaaaccctaaacccgaacccgtaacgtaccccttacgttaccgttaccttacccgtaacggtaccgtaccgtacgtacgaccgaacggacgacccggacgggtaccgacggtacgtcgtacgttacgtcgtcggtcgtcgttaccgtccgtccggtacgtccgtcgttacggtccgngtacggtgttaggcgttagtggtacgtgtcggtcgttaggtcgcggtaacggg

SEQ ID NO: 304083 - DNA, 559 bp, Homo sapiens
  misc_feature: GZ8MTXP01ED0BS.4.36.D03.1.454.CMB.2.raw
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
  modified_base (517)..(517): a, c, t, g, unknown or other
  misc_feature (517)..(517): n is a, c, g, or t
  modified_base (555)..(555): a, c, t, g, unknown or other
  misc_feature (555)..(555): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgcgtcgggtactttccgtccccgganacgtgcggtggcagggtatgatcgctatttgatatcgtggggccaaagggacaatcggtcacccgttctcttcacgccctaccaccgaacgggcccagtccggtccttccccgtggccnccctcggcctccgacggacgaccaccgtaccgacgacgacgacgacgcggccgtcggcgtcgccgtcggtcgaacggacgttaccttcccttacncgtcgttcttcgttgaacggcgggcgcggcgacggcgngaag

SEQ ID NO: 304084 - DNA, 689 bp, Homo sapiens
  misc_feature: GZ8MTXP01C6Y5D.4.36.D03.1.454.CMB.2.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
tcagagcactgtagcacgaccggtgctcgatttagctgcgtcacgatctctcctgtgtagcctctggattcacctttgacacctattggatgacctgggtccgccagtctccagggagggctggagtgggtggccaacattcggcgagatggaattgtgacacactatatggactctgtggaggccgattcaccatctccagagacaacccaagaactcactcttcngctaatnaactgctagaagagtcgaggtctagggtctatcgtatttcgtgtaggctcgggactttccgtaccccggagacgtggacggtaggcgtaagggttactagtagtagtacgtatttacggtattaggtcggtggggaacccgtaaggggaacctaacgttcggtacctaccggtccttaccgttaccaaccgtaccctaaccccgaaccgtaaccgggtcccctaacgttcccgttaccttacccccgtaggtacccctaccgtcgtaccgaccgacgggaccgtacccgaaccggtaccggaacgtacgccgtaacgtcggtcccggtccgttcgggcgttccggtacccgtcggtaacgtaacggtaccgttaccgttaccccgagtacggttcgttaccgttcgttacggtaacggtccggtgttcggtacgaacggttccggaacgtaaggg

SEQ ID NO: 304085 - DNA, 630 bp, Homo sapiens
  misc_feature: GZ8MTXP01A1WPX.4.36.D03.1.454.CMB.2.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
  modified_base (575)..(575): a, c, t, g, unknown or other
  misc_feature (575)..(575): n is a, c, g, or t
tcagagcactgtagcacgaccggtgctcgatttagctgcgtcacgatctctcctgtgtagcctctggattcacctttgacacctattggatgacctgggtccgccagtctccgaggggaaggggctgggagtggggtggccaacattcggcgagatggaattgtgacacactatatggactcgtggtggagggccgattcaccatcctccagagaccaaccccaagaactcacttctttcngacaaatgaacagcctgagagccgaaggacacggntatgttatttctggtgcgtcgggtactttccgccccgganacgtggcgggtggcgaggggtatggatgctagttttgattagtcggtagggggacccaaagggaacctaagtcggtacctaccgttctccgttcacgtccctcccgaccgaacgggccctacgttccggttccccttccccgcgggcccgtccctcgccctacgacggacgtcccacccgggtcggaacgcgaccgaaccgtccggcccggccgtacgggcctcgccgtcggtacgaacggtacccttaccttacccgngtacggtcgttccgttcgacgggtcgggccgggcgcggacgacgggccgaagaag

SEQ ID NO: 304086 - DNA, 527 bp, Homo sapiens
  misc_feature: GZ8MTXP01AMNKW.4.36.D03.1.454.CMB.2.raw
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (525)..(526): a, c, t, g, unknown or other
  misc_feature (525)..(526): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattccggcgagatggaattgtgacacactatatggactctgtggaggccattcaccatctcagagacaaccccaagaacctcactctttcngacaatgaacagcctgagagccgagacacggctatgtattcngtgcttggtactttcncccccggaactgcggtagcagggtangntagctattgatatcggtggggacccaagggacaagtggtccaccgtnttctcacggcccctaccgaccgaacgggccccagttcccggtcctttcccccgnggcccnccctacgctccgaagcgccaccggtccgagaccncgacgcgccgcgnggctcgcgtcgcaacgtcttctccagngtcncncgagcgcgcgtaggcgacgcgnng

SEQ ID NO: 304087 - DNA, 621 bp, Homo sapiens
  misc_feature: GZ8MTXP01A0N6A.4.36.D03.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (583)..(583): a, c, t, g, unknown or other
  misc_feature (583)..(583): n is a, c, g, or t
  modified_base (596)..(596): a, c, t, g, unknown or other
  misc_feature (596)..(596): n is a, c, g, or t
tcagagcactgtagcacgaccggtgctcgatttagctgcgtcacgatctctcctgtgtagcctctggattcacctttgacacctattggatgacctgggtccgccagtctccgagggaagggctggagtgggtggccaacattcggcgagatggaattgtgacacactatatggactcgtggtggagggccgattcaccatctccagagacaacctacaactacactcttcnagatgtacagttcganagaagcggagtagtcggtgtgtgtattgtgagtcgtacggtcttccgtacccggacacgtcggaggtagggacgtaggggtataggtactagtagtacgttacgtacgttaggtcgtaggggaccgtaagggaacctacgtcggtctaacccgtctaccgttaccgacgaccctacccaacgtaacgtcccttacgtacgtcccttacgacggaccacgttcgacctacgaacggacgtaccacgggacggaagccacgtgtaccgtcggtctacggctccggttctcgggtacctaacgttcgttacccgtcgagtccggagttcgttcggttncgggagttccggntaccgggatcggttaaccgtaaggg

SEQ ID NO: 304088 - DNA, 542 bp, Homo sapiens
  misc_feature: GZ8MTXP01ES5L5.4.36.D03.1.454.CMB.2.raw
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (458)..(458): a, c, t, g, unknown or other
  misc_feature (458)..(458): n is a, c, g, or t
  modified_base (502)..(502): a, c, t, g, unknown or other
  misc_feature (502)..(502): n is a, c, g, or t
  modified_base (538)..(538): a, c, t, g, unknown or other
  misc_feature (538)..(538): n is a, c, g, or t
tcagagcactgtagcacgaccggtgctcgatttagctgcgtcacgatctctcctgtgtagcctctggattcacctttgacacctattggatgacctgggtccgccagtctccgagggaagggctggagtgggtggccaacattcggcgagatggaattgtgacacactatatggactctggtggaggccattcaccatctccagagaccaaccccaagaactcacttcttcngacaaatgaacagcctagagacgccgagacacggctatgtattcngtgctcggtattcccgcccganacgtgcggtggcagggtatggatgctatttgactagtcggtggggaccaaggggaactaagtcggtacctaccgtctcttacgacgtccctaccgaaccgacggcccacgtccggtcccttccccgngcctcctgccnccgaggcnccaccgtcgagcncgacgcgtccgccgtggctcgctgacaacgtcttaccgtccagngtcacgttcgaggcggcgggctggaccgaggtccgngaag

SEQ ID NO: 304089 - DNA, 703 bp, Homo sapiens
  misc_feature: GZ8MTXP01DX87C.4.36.D03.1.454.CMB.2.raw
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
tcagagcactgtagcacgaccggtgctcgatttagctgcgtcacgatctctcctgtgtagcctctggattcacctttgacacctattggatgacctgggtccgccagtctccgagggagggctggagtgggtgccaacattcggcgagatggaattgtgacacactatatggactcgtggtggagggccattcaccatctccagacgaccaacccaagaactcacttcttctgactaaatgaacngacctggaagaggccgagaccagggctattgttatttcnggtcgcgttacggtactttcccgaccccggatacgtggtacggtggcgtagggtatggatgtacttagtttgacgttacgtcggtacggggaccgtaaaggggtaacctaagttccgggtaccctaaacccggttcctttaccgtaccgaccggtacccctacccgaacccgtaccgggtaccctacgttcccggttaccccttccccgtacgggtcccgtaccccgttcggacccgttacccgacgggtaccgtaccccgaacccgggtacccggaacggaaccgttaccgaaccggtaccggcccgggttcccgtcgggtcctaccggtccggtcgtacgtaaccggtaccttaccgtacccgttagtacgtcgttcgttcggcgaacgggcggtgtccggagaaccgtcgcgtaag

SEQ ID NO: 304090 - DNA, 539 bp, Homo sapiens
  misc_feature: GZ8MTXP01EWQPE.4.36.D03.1.454.CMB.2.raw
  modified_base (242)..(243): a, c, t, g, unknown or other
  misc_feature (242)..(243): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
tcagagcactgtagcacgaccggtgctcgatttagctgcgtcacgatctctcttggggttgtctctggagtgggtggccaacattcggcgagatggaattgtgacacactatatggactctgtggaggccgattcaccatctccagagacaaccccaagaactcactctttctgcaaatgaacagcctgagagccgaggacacggctatgtatttctgtgctcgggtatttcctccccggannacgtcggcggtggcgaggtagtgatgtctattagtatagtccgtcgggacgaaggacgagtacgtcctccgtctctcacgacccgtacccgaccgaaccggacccgtaccgtccggttcccgttccccgtccggtcccgtcccgtcgtaccgtaccgacggacgaccgaccgtaccgacggacgacgaccgacggccggcccgtcggcgtcgccgtcgtacgtaacgtacctaacctccttcgtacgttcgtcgtcgttcggcggcggcgtcggaacgacggacgacgtaagngng

SEQ ID NO: 304091 - DNA, 621 bp, Homo sapiens
  misc_feature: GZ8MTXP01AGDIV.4.36.D03.1.454.CMB.2.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (593)..(593): a, c, t, g, unknown or other
  misc_feature (593)..(593): n is a, c, g, or t
  modified_base (616)..(616): a, c, t, g, unknown or other
  misc_feature (616)..(616): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctggtggagggccgattcaccatctccagacgacaaccccaagaactcactcttcngctaatnactgctagagagcgagtcnggtntntgtnttgtgcgtcgtggtacttccgtcccgacgtcgtggacggtggcgtaggtactgatagtactatttacgagttacgtcggtagggggacccgaaagggtaacaacgttcgtacctaccgtactacctacgaccgtaccctaccacccgtaacgccctacgtccgtcctacccgtacgccgtcctgaccgtacgcggtacgccgaaccgggtaccggaagtaccgtacgacgtccggtacgtccggtacgggtcccgttgtacccgggttacgaaccggtaacgtccgttaccgtacccgaggtacgtcgggttcttggcgtcggngtaaccgtgacgacgtcgttaanaacgg

SEQ ID NO: 304092 - DNA, 595 bp, Homo sapiens
  misc_feature: GZ8MTXP01BA88N.4.36.D03.1.454.CMB.2.raw
  modified_base (313)..(313): a, c, t, g, unknown or other
  misc_feature (313)..(313): n is a, c, g, or t
  modified_base (493)..(493): a, c, t, g, unknown or other
  misc_feature (493)..(493): n is a, c, g, or t
  modified_base (519)..(519): a, c, t, g, unknown or other
  misc_feature (519)..(519): n is a, c, g, or t
  modified_base (530)..(530): a, c, t, g, unknown or other
  misc_feature (530)..(530): n is a, c, g, or t
tcagagcactgtagcacgaccggtgctcgatttagctgcgtcacgatctctcttggggttgtctctggagatggtgaatcggccctcacagagtccatatagtgtgtcacaattccatctcgccgaatgttggccacccactccagccccttccctggagactggcggacccaggtcatccaataggtgtacaaaggtgaatccagaggctacacaggagagtctcgacgggaccccccaggctacggaaccaacgccctaccccagaccctccaaccaaatcgcccctacacactcggacaccttataaaanagacaaacaaacggaaaaccctagacctacacgaccccaaatttccaagtcggtagacgtcctctgtcgactcacgtgctgactacaacgaaggtaggaaacgtcgtggactcgaggtacgaagctctactctgaccgacctcaaccgaaacgggccctaaggtccggtcccttccccgngggccctccctgcctaccgaggaccnccaccgcgaancgcacgcggtccggccgttggcttcggtcgtacggaacaacggtaccttaccgtccgttaacgtg

SEQ ID NO: 304093 - DNA, 671 bp, Homo sapiens
  misc_feature: GZ8MTXP01ET5HZ.4.36.D03.1.454.CMB.2.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccaganaccaaccccaagaactcactctcagctatnattgcagaagagcgagtcgtgggtntntgtatgtggtgcgtggtacgtcgccgacgagtagcgtagagtaggtactagtatagtacgtagttagtacgtaggtacggtacggggtacgtaacggtaaacctacgttcggtacctaacccggtacctaaccgtaacccgaaccggtaacccctaacccgtaacccgtaaacccggtaccttaaccgtccgttacccttaccgtaccgtaccgacctacgacgacaagggaaccgacccgtaacccggagttaacggacgttaacgtacgtaccgtcggtacgttcggtacgttcggtccgttacggtacccgtaacggttacgtttaccgggcccgttaggtacgggttcgagtttcggaagtccgggtacgtaacggttggaccggttaggcggttaacgtaagg

SEQ ID NO: 304094 - DNA, 579 bp, Homo sapiens
  misc_feature: GZ8MTXP01ENVQ5.4.36.D03.1.454.CMB.2.raw
  modified_base (208)..(208): a, c, t, g, unknown or other
  misc_feature (208)..(208): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagagcactgtagcacgaccggtgctcgatttagctgcgtcacgatctctcctgtgtagcctctggattcacctttgacacctattggatgacctgggtccgccagtctccgaggggaaggggctggagtgggtggccaacattcggcgagatggaattgtgacacactatatggactctgtggaggccgattcaccatctccaganacaaccccaagaactcactctcagctagttcattgcagaaagagtcgaaggttctggtntagtntatgngtgtcgtgacttcgacccganacgtgagtagagtaggtatagatgagtatagactgacgtaggacctaggaacagttcgactacnctacacgacacaccactaacgccttacgactacctcgtaagctaccagacgtcaacggacgacgtacggaccgagtacgacgtaacgcgtccgtacggttcggtctcgtaccggtcgtaacccggtaacgttaccgttccggtacgttacgggtaccgtggttacgttcgttacggtaaggtacgtaacgtagtacgttacgtaacgttaacgtaag

SEQ ID NO: 304095 - DNA, 835 bp, Homo sapiens
  misc_feature: GZ8MTXP01D7UFP.4.36.D03.1.454.CMB.2.raw
  modified_base (275)..(275): a, c, t, g, unknown or other
  misc_feature (275)..(275): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcgggcgagatggaattgtgacacactatatggactctgtggaggccgattcaccatctccagagaccaacccaagaactcacttcttctgacaaatgaacagcctgagagcgaggacacggctatgtatttcngtgtcgtcgggtactttcccgtaccccggactacgtcggcgggttgggacgtaagggggtttatggtattcggtacttagttttacggtaattacggtcggttacggggggaaccctaaaggggggtaaacctaaaggtttccggggtacccttaaaccccgggtttcctttacccgtttaccgacccggtaccccgttacccccgaaacccggtaaacccgggggtcccccttaaaccgggtttccccgggtttaccccccgttttacccccccggggttcggggtaccccccggttcccccggttccggaccccgttaccccgggaaacggggtacccgaccccgtaaccccggggttacccgggaaacggaccggacccggaaccggacccggggttccccgggccccggttcgggggtcccttcccggggtacccggttccgggtaaaccgtaaaccgggtaacccctttacccgtttacccccgttaaaggtaccggttcgttccgttcggttacggaacggggtcgggaacgttacgggacgacggtcgctaag

SEQ ID NO: 304096 - DNA, 669 bp, Homo sapiens
  misc_feature: GZ8MTXP01DK2WV.4.36.D03.1.454.CMB.2.raw
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttcngacaaatgaacagcctgagagccgaggacacggctatgtatttcngtgctcgggatttccgtccccggacactgcggtggcagggtatgatgctatttgatatcgtgggggcccaaaggggaacaaagtcgggtaccaacccggttcttacctttccgacgtccccttaccccaacccgtaaacggggccccctaacgtcccgggttcccctttcccccccgttgggccccgtccccgttcggcccttcccgaacgggacgcccaacccggtaccggaacgacgaccgaaccgaacggcccggccccgttgggggcccttcggccccgttggggtacccaaacggggtacccttaccctttaccccgttaaaccgcggttacgccgttcgttcgggaacggccggggtctcggggaccgttaaaggccgaacctaag

SEQ ID NO: 304097 - DNA, 491 bp, Homo sapiens
  misc_feature: GZ8MTXP02GXL04.4.36.D03.1.454.CMB.2.raw
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgcaaatgaacagcctgagagccgaggacacggctatgtatttctgtgctcgggatttcnccccgganactgcggtggcagggtatgatgcatttgatatcgtggggccaagggcaatggtcacgtctcttcagcctccacaaggcccatcgtctcccctgcnccctgctccaggacgcacctccgagacgcacacgcgccctgggctgcctggcaacggctacttcccacagtcgctctgaagcgggctgcgacgcgcag

SEQ ID NO: 304098 - DNA, 517 bp, Homo sapiens
  misc_feature: GZ8MTXP02GHICW.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttcctccccggacactgcggtggcagggtatgatgcatttgatatcgtggggccaaggggacaagtgggtcaccgtctcttcagcctccaccaagggcccatcggtccttccccctggccgccctgcctccgaggacgccacctccgagacgcacacgccggccctgggctgcctggtcaacggactacttccctacacgtcgctcgtgaagcggctcggcacggcgacag

SEQ ID NO: 304099 - DNA, 620 bp, Homo sapiens
  misc_feature: GZ8MTXP02GIBYA.4.36.D03.1.454.CMB.2.raw
  modified_base (230)..(230): a, c, t, g, unknown or other
  misc_feature (230)..(230): n is a, c, g, or t
  modified_base (266)..(266): a, c, t, g, unknown or other
  misc_feature (266)..(266): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactcttcngctaatgaactagctgaagagccgaggtcacgggtntatgtattctgtgcgtcggtacttccgtacccggatacgtggcggtggacgtagggtatgtatgactagtttgattacgtcgtaggggaccaagggactaagtcggtaccaccgtctacctacacgaccctacccaaaccgaacggtccctacgtccgtacccttccccgtacgacccgtaccctagacctaccgacggacgaccgaaccgtaccggagacgacgaacgtacggccggtccgtggtctcggtacccgtcggtaccgaacggtaccttacccgttcccgtacgtacggtcgtaccgttcgtaggaacggtcgggtacgtacgggacgtaacgggccgtacgtaag

SEQ ID NO: 304100 - DNA, 609 bp, Homo sapiens
  misc_feature: GZ8MTXP02FWOQK.4.36.D03.1.454.CMB.2.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcagctatnattgctagaagagtcgaggtctacggggtntntgtnttgtgtgcgtcggtacttcgtccgactacgtggtacggtggtagtaggtatagtatagatagttgtacgtagtcggtcgggacgtaggactacgtcgtcctacgtactacctaccacgacctaccaaccgtacgtccctacgtccgtacctacccgtagacctaccgtacgacgtacgacggacgaccgaccgtaccggagacgtacgtacgtcgtcggtccgtcgggtcgtccgtaccgtcggtaccgtacggtaccgttaccggtccgtacggtacggtcgtacgtcgtacggtaacggtcggtacgtacggacgtaacggtccgtacggtacg

SEQ ID NO: 304101 - DNA, 576 bp, Homo sapiens
  misc_feature: GZ8MTXP02G6ZHE.4.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactcttcngcaatnaatgctgaagagcgaggtcagggtctatgtattctggtgcgtcgggatttcgtccccgganacgtgacggtggcgtagggtntagactagtacatttgattagtcgtcggggaccaagggtacaagtcggtcctacgtctactacagccctaccaaccgaacgtcctacgtcggtacctccccgtgaccgcctcggctacgacggacgccgaccgtcgacgacgtcgactacggtccgtccgtggtctcggtccgtcgtaccgaacggtaccgttcgtcccgtagtacggtcgtctacgtcgaaggtcggtacgttcggtacgtacggacgacgtaacgg

SEQ ID NO: 304102 - DNA, 607 bp, Homo sapiens
  misc_feature: GZ8MTXP02GW3OS.4.36.D03.1.454.CMB.2.raw
  modified_base (300)..(300): a, c, t, g, unknown or other
  misc_feature (300)..(300): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttcctccccgganactgcggtggcagggtatgatgctatttgattatcgtggggaccaaggggacaagtcggtccaccgtctcttcacgccctccaccaacggcccagtccggtcccttcccccgtcggcccgccctcgcctccgaggacgcccacccgtccggagacgccaccgacggcccggccccgtgggggccttcggcccgttacggggtacccaaaacgggtacccttaacccgtttcccccgtaacgacggttccggtccttccgtacggaacgggcccggggtacgtcggggaccgaaacgggccgacgaag

SEQ ID NO: 304103 - DNA, 559 bp, Homo sapiens
  misc_feature: GZ8MTXP02JQG87.4.36.D03.1.454.CMB.2.raw
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagccctcccccagacctccaccaattcgcccctcacactggaccaccttactaaaatagcaaacaaaggaaaacccagctacacgaccccaattccaatggtgacgtcctcctgtgctcagtgctgatcacagtggaaagctggagtccgaggctaaggctcctctctgacgaccctcaccgaagggcccagtcccggtcttcccccgnggcccncccgtgcctccgaggacgccaccgtccgacgacgccacgacgccggcccgtcggggctcgccgtggtacaacggtactaccgttaccctacgtacg

SEQ ID NO: 304104 - DNA, 715 bp, Homo sapiens
  misc_feature: GZ8MTXP02F855M.4.36.D03.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctcaggctagtcattgcagaaagngtcgagttctcggggtntctgtagttcgnggtggtcgtaggtactcgtccggtacgacgtagacggtgtagtaggtactacgtactagtcgtacgttcgtaccgttaggtcgtacggggaccgtacggtaccgtacgttccggtaccaccggttacgtacccgttaaccccaaaccgggtaaacccctaaacccgtaaccctaaacggttacccttacgttaccggtaaccttacccgtagacccgtaccgtacgtacaccgacggaaccggtccgaaccgggttacccgagtacgttaccggttacttacggtacggttccgtcggggtaaccgtttccggtaaccccggtttcggtaccccggtaaacggtaccgttccgggttaccggtaaccgggtggttacgtaaccgtaggttcggaaccgtcgttagtaccgttaggaacggttccggaagtaacggg

SEQ ID NO: 304105 - DNA, 533 bp, Homo sapiens
  misc_feature: GZ8MTXP02IHX6K.4.36.D03.1.454.CMB.2.raw
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (491)..(491): a, c, t, g, unknown or other
  misc_feature (491)..(491): n is a, c, g, or t
tcagagcactgtagcacgaccggtgctcgatttagctgcgtcacgatctctcctgtgtagcctctggattcacctttgacacctattggatgacctgggtccgccagtctccagggagggctggagtgggtggccaacattcggcgagatggaattgtgacacactatatggactctgtggagggccgattcaccatctccagagacaaccccaagaactcactctttcngcaaatgaacagcctgagagccgaggacacggctatgtatttctgtgctcgggatttcctccccgganacgtgcggtggcagggtatgatgctatttgatatcgtggggaccaagggacaagtgggtcaccgtctcttcagcctccacgaggcccagtccggtccttccccgnggccgccctgcctccgaggacnccacctccgagacgcacgacgccggccgtgggctgccgtggacaacggtaccttacctccctaacncgttcgcctcgtggaacggcgggactcggacaacggcacgag

SEQ ID NO: 304106 - DNA, 538 bp, Homo sapiens
  misc_feature: GZ8MTXP02F72NS.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaaccccaagaactcactctttctgcaaatgaacagcctgagagccgaggacacggctatgtattctgtgctcgggatttcctccccggacactgcggtggcagggtatgatgctatttgatatcgtggggaccaagggacaagtggtcacgtctcttcagcctcacaacggcccatcgtctcccgtgccgcctgctccaggacgccaccgtccgagacgcacgacgccggccctgggctgacccgtggtaccaaacggaccttaccgttccccaacgtacggtcgctccgtaggaacggcggggtactcgggaccgaaggccgacaag

SEQ ID NO: 304107 - DNA, 542 bp, Homo sapiens
  misc_feature: GZ8MTXP02GWJ6S.4.36.D03.1.454.CMB.2.raw
  modified_base (410)..(410): a, c, t, g, unknown or other
  misc_feature (410)..(410): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgagacacggctatgtatttctgtgctcgggatttccgtccccggacactgcggtggcagggtatgatgctatttgatatcgtggggaccaagggacaagtggtccacgtctctcacgccctccaccaacggcccatccggtccttccccctggccnccctgcctccgaggacgccacctccgagacgcacgacgccggcccgtggggcctcgccgtcggtacaaacggtacctaccgttccctaacgacgttcgcctcgtgaacgcgggctcggacaacggccgacag

SEQ ID NO: 304108 - DNA, 561 bp, Homo sapiens
  misc_feature: GZ8MTXP02F0NV5.4.36.D03.1.454.CMB.2.raw
  modified_base (408)..(408): a, c, t, g, unknown or other
  misc_feature (408)..(408): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttcctccccggacactgcggtggcagggtatgatgcatttgatatcgtggggccaagggacaatggtcaccgtctcttcagcctccaccgaagggcccagtccggtccttcccccgtggccnccctgcctccgaggacgccaccgtccgagacgccaacgcgccggcccgtggggcctcggacccgtgggtaccaaaacgggtacccttaccttccccctaaagacgttcgcctccgtaggcggccggggctacgggaccgaagggcccgactag

SEQ ID NO: 304109 - DNA, 544 bp, Homo sapiens
  misc_feature: GZ8MTXP02HA57G.4.36.D03.1.454.CMB.2.raw
  modified_base (299)..(299): a, c, t, g, unknown or other
  misc_feature (299)..(299): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccgganacgtgcggtggcagggtatgatgctagttttgattatcgtggggaccaaggggaccaagtcggtaccaccgtctcttcacgcctccaccacgggcccagtccggtccttcccccgtggccgccctgcctccgaggacgcacccgtccgagacgcacacggccggcccgtgggctcgcccgtggtccaacggcctaccttccctacacgtcgtactctcggaacgtcgggctcggcgacggcgcag

SEQ ID NO: 304110 - DNA, 528 bp, Homo sapiens
  misc_feature: GZ8MTXP02IKC0U.4.36.D03.1.454.CMB.2.raw
  modified_base (276)..(276): a, c, t, g, unknown or other
  misc_feature (276)..(276): n is a, c, g, or t
  modified_base (447)..(447): a, c, t, g, unknown or other
  misc_feature (447)..(447): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttcngtgctcgggatttcctccccggacactgcggtggcagggtatgatgcatttgatatcgtggggccaaggggacaagtggtcaccgtctcttcagccctccaccaagggcccagtccggtccttcccccgtggccgccctcgcctccgaggacgccacctccgagacgcacngccggcctgggctgcctggtacaacggaccttacttcccacacgtcgctctggaacggcggcgtcggacaacggcgacaag

SEQ ID NO: 304111 - DNA, 568 bp, Homo sapiens
  misc_feature: GZ8MTXP02G4W5S.4.36.D03.1.454.CMB.2.raw
  modified_base (304)..(304): a, c, t, g, unknown or other
  misc_feature (304)..(304): n is a, c, g, or t
  modified_base (539)..(539): a, c, t, g, unknown or other
  misc_feature (539)..(539): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcacttctttctgacaaatgaacagcctgagagccgaggacacggctatgtatttctgtgcgtcgggtatttccgtcccccgganacgtggcggtggcgagggtatgatgctatttgatatcgtggggaccaaggggacaagtcggtccaccgtctccttcacgccctacccaccgaacgggccctagtccggtcccttcccccgtggcccgccctcgcctaccgaggacgcctaccgtccgagacgcacgacgccggcccgtggcctcggccgtggtaccaaacggtacccttaccttcccctagacgttcgccttcgnggaacggcggcgtcggacgacggcgacag

SEQ ID NO: 304112 - DNA, 744 bp, Homo sapiens
  misc_feature: GZ8MTXP02JESEM.4.36.D03.1.454.CMB.2.raw
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactcttcagctatnattgctagaagngtcgaaggtctaggggtctatcgtattcgtggtgtccgtacgggacttccgtcccggacgacgtggtacggtggtcgacgggtatacgtatagacgtaagtttcgtagttagtacgggttcggggacccgtaacggggtacctaacgttcgggtaccctaacccggttctacccgttaacccgaaaccggaacccctaacccgtaaacccgaaccgggttaccccttaacgttccggggttaccctttaccccgaacggtacccgtaccccgttacggtaccgtaccgtaacgggaaccgtacccgtaaaccggaccccgtaaggtaccggtacttaaaccgtggtcccggttaccgttcggggtacttccggtcccgtttacgggaacccgtaaacggtccggttaccgttaccccgaacgggttaggttccggtaacgttcgtacgggtaacggttacggtacgtacggtacgtacgggtaccggacgtaaacg

SEQ ID NO: 304113 - DNA, 566 bp, Homo sapiens
  misc_feature: GZ8MTXP02H8K6M.4.36.D03.1.454.CMB.2.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactcttcngcaaatgaacagcctgagagccgagacacggctatgtattcngtnctgggatttcnccccgganacgtgcggtggcagggtatgatgactatttgaatattcgnggggacctaaaggggctaaagtggtcaccgtntcttacgacncctaccaccgaacgcctacgtccgtccctccccgtggccgcctcgcctcgaggacgccaccgtacgagacgaccacgacggcccggtccgtcggccgtcggtccgtacggtaaccgaacggtaccgttaccttaccctacgtacggtcgtcgttacgcgcggtcggacggtacggacgacggacgacgacg

SEQ ID NO: 304114 - DNA, 580 bp, Homo sapiens
  misc_feature: GZ8MTXP02HHJ2C.4.36.D03.1.454.CMB.2.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctcaggctagttcattgcagaaagngtgagttctggggtntgtntntgngtgtcgtgtgtcgtcgagacgtagtagtagtagtagtatagtatatagtagtacgtacgtgtacggtacggacgtacgtacgtacgtcgtacctactacgtaccaaccgaaccaacctaccaacctaccgtacctacgtactactactacgtacgtacacgacacgacgacgacgacgacgtacgtacgtactacgtagtcgtcgtacgtcgtcggtaccgtacgtaccgtacgtaccgtacgtcggacgtacgtcggtacgtacgtacgtaagtacgtagtacgtacgtcggtacgtacgtacgg

SEQ ID NO: 304115 - DNA, 622 bp, Homo sapiens
  misc_feature: GZ8MTXP02G3944.4.36.D03.1.454.CMB.2.raw
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcgacgggacccccaggctggaccaagccctccccagacctccaccaatcgcccctcacactgacaccttacaaaatagacaaacaaacggaaaacccagacctacaacgacccccaaattcccaatcggtagacgtcctacctgtcgctcagtgctgactcaaccgtaaagtgggaaaacgtccttagggaacgtccgaaaggggtcctaaagggcctcccttctaccgtagaacgtaccctaccgaaccgaaacggggcccctaagtcccggttccttcccccgngggcccnccccgtgcctccgacggacnccacccgtccgagacgcaaccgcggtcccggcccgtggggcctcggcccgtggtacaaacggaccttaccgtcccctaagtacg

SEQ ID NO: 304116 - DNA, 624 bp, Homo sapiens
  misc_feature: GZ8MTXP02HNSTW.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcacgggacccccaggctggaccaagccctcccccagacctccaccaattcgcccctcacactggaccaccttactaaaatacgacaaacaaaggaaaacccagacctacaacgacccccaaattccagtggtgacgtcctcctgtcgctcagtcgctgactcaccaagtcgggaaagccgttaggagtccgagggctaaggctcctctctgacgaccctccaccgaaacgggcccctagttacccgggttcccttacccccgtgggccccgtccccgtggccctcccgaggaccgtcccgacccgtccggaacgacgccgaacgtacggcccggcccgtcggggcctcggtaacccgtgggtaccaaacgggacctttacccgttcccgtaacgtacgg

SEQ ID NO: 304117 - DNA, 624 bp, Homo sapiens
  misc_feature: GZ8MTXP02G8C0A.4.36.D03.1.454.CMB.2.raw
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcagctagttcattgcagaagagtcgagtctgggtctatntntcgtgtggtcgtcggtacttcgtcccggagacgtggacggtggtacgtaggtactacgtactagtacgtagttacgacgttagtcggtcggggaccgtacggactacgtcgtacctacgtaccgtacgtaccaacgaaccctaccaaccgtaccgtaccctatccgtactaccctagtacccgacctagaccgtacgaacggacggtaccgaccgtaccggtacgacgtacgtacgtacgtcgtcgtcggtcgttcggtccgtcgtaccgtaacggccgttaccggtccgtcggacggtcggacgttcgtacggtcggtacgtacgtacggtacgtacggtacggtacgtaacg

SEQ ID NO: 304118 - DNA, 667 bp, Homo sapiens
  misc_feature: GZ8MTXP02F6C57.4.36.D03.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngctaatnaactagctagaagagtccgaggtactagggctatgtatttcgtggtgcgtcgggaatttcgtccccgganacgtgcggtggacgtagggtatgaatgactagtttgacttagtcgtaggggtaccgaagggtaccaaatcgggtccacccggtctaccttaccgaacggacccttacccaaaccgaaccgggtccccttaacgttcccgggttaccctttacccccgtaggaccctacccggtcgtaccgtaccgaaggtacgacccgtaccgtaccggacgtacgtaccgtaacgtcgtccgggtccctggggtaccgtcgtaccgtcgggtaccgaaaacggtcctaccgttacccggtaagtacgggtcgtacgttcgaggtaacgggtccggtggttacggacggtaacgtcgggaccgtaaagg

SEQ ID NO: 304119 - DNA, 547 bp, Homo sapiens
  misc_feature: GZ8MTXP02IXPYN.4.36.D03.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaacccaagaactcactctcagctatcattgcagaagagtcgagtctagggtntatgtntcgtggtgcgtggactcgtccgnacgtgcgtgngtaggtangatatactattgactgtcggtcggacgtacggactacncgtcacgtctacgtaccacacctaccacgtacgtcctactcgtctaccgacgtcactacgctacgagacgacgaccgccgagcgtatacgtacgtcgtacgtcggtacgttcgccgtacgtactaacggtccttacggtccgtacggtacggtcgtacgtcgtgtaacgtcgtacgtagtaccgtaggtccggagtaacgg

SEQ ID NO: 304120 - DNA, 547 bp, Homo sapiens
  misc_feature: GZ8MTXP02I11O2.4.36.D03.1.454.CMB.2.raw
  modified_base (299)..(299): a, c, t, g, unknown or other
  misc_feature (299)..(299): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgcaaatgaacagcctgagagccgaggacacggctatgtatttctgtgctcgggatttcctccccgganactggcggtggcagggtatggatgctattttgattatcgtggggaccaaagggacaatgggtcaccgtctctcagcctcaccaggcccatccggtccttccccgtcgcccgccctgcctccgagacgccacctccgagacgcaacgcgccgccctgggcctcggcctggtaccaaacggtaccttaccttcccctactacggtcgtcctcgtaggcggtccggggctcgggcgaaacggccgacgaag

SEQ ID NO: 304121 - DNA, 694 bp, Homo sapiens
  misc_feature: GZ8MTXP02JBI5D.4.36.D03.1.454.CMB.2.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngcaatnactgctgaagagcgagtcagggtntatgtattctgtggcgtcgggactttcgtccccggacacgtggcggtaggtcgtaaggggtactaggacttagtctaagtttttacggagttaacgttccggttacggggggacccctaaagggggtaaccctaaacgttccgggggttaccctaacccccgggttaccgtaccctttacccgaaacggtaacccccttaccccgaaacccgaaacggggtaccccctagttacccgggttccttaccccccgtaggaccccggcccttacgacgtacccgagggacgccgaaccgtacgagacgctaacgtagtccggtcccgtggggcctcggtccgtcggttaccgaacggtacccttaccgttcccgttaaacgacggttcgcgttcctaggaacgtcgggtacttggaccgtaaggccgtacgtaagg

SEQ ID NO: 304122 - DNA, 557 bp, Homo sapiens
  misc_feature: GZ8MTXP02H0R0F.4.36.D03.1.454.CMB.2.raw
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaacccaagaactcactcttcagctagtcattgctagaagagtcgagtactgggtntntntntgtgtgtcgtagtactcgcgagacgagtagtgagtagtatnatatatatanacgtgtcgtacggacgtagacatcgtactactctactacacgacacactacgtactactctacctactacgacgctacgacgtacgacgacgtaccgacgtacgtacgacgtacgtacgtacgtccggtcgtcggtcgtaccgtaccgtacgtaccgtacggtaccgtaccgtaccgtacggacgtacgtacgtacgtacgtaacgtacgtacgtacgtacgtacgtacgtacgtacg

SEQ ID NO: 304123 - DNA, 560 bp, Homo sapiens
  misc_feature: GZ8MTXP02IG74N.4.36.D03.1.454.CMB.2.raw
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaaccccaagaactcactctcaggctagttcattgctagaaagagtcgagttctggggttntntntntgtgtgcgcgacgtcgtcgngagtgngtagtgtagtatatatagtatagtgtacgtgtcggtcggacgtacgtactactcgtacctactaccaccgtaccaacgacctaaccacctaccgtaccttactcgtactacgtacgtaccgtacgacgacgacgacgacgaccgacgacgtacgtacgtagtacgtcgtcgtcgtcgtcgtcgtccgtccgtacgtacgtcgtcgtcgtacggtcgtcgtacgtgagtcgtagtcgtagtacgtacggtacgtacgacg

SEQ ID NO: 304124 - DNA, 563 bp, Homo sapiens
  misc_feature: GZ8MTXP02JSMAC.4.36.D03.1.454.CMB.2.raw
  modified_base (247)..(247): a, c, t, g, unknown or other
  misc_feature (247)..(247): n is a, c, g, or t
  modified_base (262)..(263): a, c, t, g, unknown or other
  misc_feature (262)..(263): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaacccaagaactcactctcagctagtcattgcagaagngtcgagtctggggtnntntgtgngtgcgagtntcgcgngngtgngtgagagtanagatagtatagtntacgtgtgcgacgtacgactacgtcgtcacgtacacaccacgaccaccactactacctactcgtactaccganaccgactacgacgacgacggacgacgaccgacgtacgtacgtacgtacgtacgtcgtcgtcggtcgtaccgttccgtaccgtaccgtaccggtccggtccgtacggtacggtacggtacgtacgtacgtacggtaacgtcggtacgttacggtacggtacggtcggtaacggtacg

SEQ ID NO: 304125 - DNA, 589 bp, Homo sapiens
  misc_feature: GZ8MTXP02F47GS.4.36.D03.1.454.CMB.2.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactcttcngcaatgaactgcctagaagagtccgaggtactacgggctatgtattcgtgtgcgtcgggattccgtcccgganacgtgcggggtncgtagggtatgatgctatttgatagtcgtggggccaagggacatcggtcacgtctctccacgcctaccaccgaaggtccccagtcgtctcccctggccacctgctccgaggacgacgaccgtccggagacgtacacgtacggtccggtcccgtggggtccttggtccccgttagggtacccgtaaacgggtacccttaccgtttccccgtaaacgcgggttcgaccgttcgtaggaacggtcgggtcttagggaccgaagggtccgacgtaacgg

SEQ ID NO: 304126 - DNA, 535 bp, Homo sapiens
  misc_feature: GZ8MTXP02F1TJ9.4.36.D03.1.454.CMB.2.raw
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagacaaacaaaggaaaaccccagcctcagcccccaaattccatggtgagtcctctgtgctcagtgctgatcacagtgaaagctggatcaggctaaggctctnctgagacctcaccaagggccccagtccggtccttccccctgggccgcccctggctcccgaggngccactcccgagacgcacgagccggccctgggctggccctggtaccaacggtcctacttcccgactacgg

SEQ ID NO: 304127 - DNA, 636 bp, Homo sapiens
  misc_feature: GZ8MTXP02HZBSB.4.36.D03.1.454.CMB.2.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngcatnatgctgaagagcgagtctacgggtctatgtattcgtgtgcgtcggatttcgcccgganacgtggcggtggcgtaggtatcgtatgactattcgatgtcgtgggctaggacatcggtacacgtctaccttaccacgacctacccacgtacggtccctacgtccgtccttaccccgtggaccctcccgtacgccgtaccgacgggaacgtccgaacccgtccggaacgtacgtaccgtaaccgtacgggtcccggtacccggttcgggtccgttccggtaccgtccggtaccgtaaccggtaccgttacccgttacccgtacggtacggtacggtaccgtcgtacgggtcggttaccggggtccttaggggaccgtaacgggtaccggttaccgtaaacggg

SEQ ID NO: 304128 - DNA, 579 bp, Homo sapiens
  misc_feature: GZ8MTXP02J2ZJE.4.36.D03.1.454.CMB.2.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaacccaagaactcactcttcngcaaatgaacagcctgagagccgaggacacggctatgtatttcngtgctcgggatttcctccccgganactggcggtggcagggtatgatgctagtttgatagtcgtggggaccaaggggacaagtcggtcaccgtctcgttcacgtccctccaaccgaaacgggcccctagttcccgggttccctttcccccgngggcccgaccccgttggcccttccgacggacggaccacccgtacggagacgccaaccgcggcccggccccgtggggcctcggccgtgggtacaacgggtacctaccttccccaatcgtcgcctcgtcgaacggcggcgcggacaacggccgactag

SEQ ID NO: 304129 - DNA, 544 bp, Homo sapiens
  misc_feature: GZ8MTXP02F08CZ.4.36.D03.1.454.CMB.2.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (515)..(515): a, c, t, g, unknown or other
  misc_feature (515)..(515): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaaccccaagaactcactcttcagctagtcacttgcagaaagngtcgagtctaggggttntgtntgtgtgtgtcgtcgtactcgcgancgtgagtgagtagtatgtatatatatagtacgtagtcgaggacgtagactagtcgtacacgtctacctacgacgaccacaccgtacgtacctacgtctactaccctacgaccgactacgacgacgacgacgaccgacgacgacgacgtacgtacgtacgtcgtcgtcggtcgtcgtccgtacgacgtacgtccgtacgtcgtagtcgtcgtcgtcgtgngtcgtcgtacgacgtacgtacgtacgacg

SEQ ID NO: 304130 - DNA, 733 bp, Homo sapiens
  misc_feature: GZ8MTXP02J2VKQ.4.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactcttcngcaatnaactgcctagaagagccgagtacacgggctatgtatttcngtgctcgggtactttcgtccccgganactggcggtggcagggtatggatgacatttgatagtttcggacgggggacctaaggggacctaaagttcgggtacctaacccggtcctaccgttaccgaacggtacccctaccccaaacccgtaaaaccgggggtcccctaacgttcccggggttaccctttaccccccgtaggggtaccccgtcccccgttacgacccgttacccgaacgggtaaccggacccaaccccggtacccgggaacgacgaccgtaaccgtacggcccgggtaccccgtcgggggtccttccggtccccgttacggggtaccctaaaaccggggtacccttacccggtttaccccgtacgtaccgggttcgaaccggttcccggtgggtaacgggtcccggggttcgtacgggtaccgtaaacggggtccggtaccgtaaacgg

SEQ ID NO: 304131 - DNA, 560 bp, Homo sapiens
  misc_feature: GZ8MTXP02GVQFK.4.36.D03.1.454.CMB.2.raw
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (535)..(535): a, c, t, g, unknown or other
  misc_feature (535)..(535): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaaccccaagaactcactctttcngcaaatgaacagcctgagagccgaggacacggctatgtatttctgtgcgtcgggatttccgccccgganacgtgcggtggcgagggtntgatgctagtttgattagtcgtggggaccaaagggacaagtcgggtactaccggtctccttacgacgccctacccgaaccgacgggcccctagttcccggtcccttcccccgtcgcccgcccgtcgcctccgaggacgccacccgtccgagacgcacgacgccggccgtggctcgccgtgtacaacggtaccttactccctacagtcgccttgngaacggcggctcgggcaggcactag

SEQ ID NO: 304132 - DNA, 623 bp, Homo sapiens
  misc_feature: GZ8MTXP02HMNJE.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccacgccccttccctggagactggcggacccaggtcatccaataggtgtcaaaggtgaatccagaggctacacaggagagtctcgacgggacccccaggctggaccaagccctccccagacctccaccaattcgcccctcacactggaccaccttactaaaatagacaaacaaacggaaaacccagacctacacgaccccaaattccatggtgacgtcctcctgtcgctcagtgctgatcaacctaagtggaaacggccgttagggacgtcccgagggctaaggcctcctctctgacgaccctccaaccgaacgggcccctagtcccgggttcccttcccccgtgggaccccgtccccgtcgcccgtccgacggcgccgacccgtaccggaacgacggccaccggacggcccgggccctcgggggcctcggaacccgtgggtaaccaacgggtacccttaccgtttcccctaacgtacgg

SEQ ID NO: 304133 - DNA, 629 bp, Homo sapiens
  misc_feature: GZ8MTXP02JWFUF.4.36.D03.1.454.CMB.2.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (324)..(324): a, c, t, g, unknown or other
  misc_feature (324)..(324): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaaccccaagaactcactctcagctagtcattgcagaagngtcgagtctgggtntgtntgtcgtggtgtcgtacggtactccgtccggagtcgtaggtacggtaggtcgtaagtanacgtactactagtacgttacgtaccgtaggtggtacggggtacgtaggcccccgttaagtccggtaccaccttacggactaaccgacgaaacctacccaacctacggttacctacttacggtaacctaccgtcgacgtaccacgtacgacgacggacggtacgaccggtacgaacgttcgagttacgtctcgtacgtcggtcgtacgtccggtacgtacgtaccggtacgttcggcccggtacggtacggacgttacgtacgttgaacggttacggtcgtacgtaacggtccgttacggacgacg

SEQ ID NO: 304134 - DNA, 774 bp, Homo sapiens
  misc_feature: GZ8MTXP02HYPLJ.4.36.D03.1.454.CMB.2.raw
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctcagctagttcaattgcagaagagtcgagtctgggtntntgtntcgngtgcgtcggactcgtccgacgacgtcggaggtggtagtacggtatacgtatagtacgtacgttagtacgtagttacggtcggggacgtacggtaacctaacgtcggttacctaccgttaccgtaccgttaaacccgaaaccggtaacccttaaacccgaaccgtaaacccggttccccttaacgttcccggtttaacccttaccccgttaaggtaccccgtacccgttaacggaccgttaacccggaacgggaaccggtaacccgtaacccggaacccgggttaaagtacccgggttaacgtaaacccgtttacggtacccgggttaccggttaccggggtaccggtttacccggttcccgggtttaccccggttacccggtaaccggttaacccggtttcccgggtaccccggtaagggtacggttccggtaacgtcggtaacgtggttaacgggtccttaggttaccgacggggtttaccggtaacggtaaaccgggg

SEQ ID NO: 304135 - DNA, 673 bp, Homo sapiens
  misc_feature: GZ8MTXP02F5ZWD.4.36.D03.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagacaaccccaagaactcactcttcngctaatnatgctagaagngcgagtctggtctagtgtatttcgnggtcgcgtacgggcttcgtcccggagacgtggcggttggcgtagggtatacgatgtacctagtttcgagttcgtacggtcggggaccgtaagggacctaacgttcggtacctaccgtcgttaccttaccgaacgtacccctaccgaaccgtaaacggtccctaagtttccggtaccttccccgaggaccctaccgttacggactaccgacggaaacggccctaccgtaccgggcgtaacgtaccggtacgtacgtccgggtcccgttggggccttcgggaccgtttacgggaccgtaaccggttaccgttacccggttacccgtacgggtacggttcgtacccgtcggttaggaacggttcggggtactacggggttaacgacgggtcccgaggtaaacgg

SEQ ID NO: 304136 - DNA, 606 bp, Homo sapiens
  misc_feature: GZ8MTXP02ICOUR.4.36.D03.1.454.CMB.2.raw
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngctagtcattgctagaagagtcgagtctagggtntntntntgtgtgcgtggtactcgtccgacgtgtgngtgngtagtntagatanatntgtacgtgtcgtcggacgagtactacgtcgtactacgtactaccgtaccgacgtaccctaccgaaccgtaccgtacctacgtaccgtacctacccgtacgtaccgtaccgtacgtacgacgacgaccggtaccgaccgacggtaacgtacgtacgtacgtacggtccgtcgtcgggtcgttccggtaccgtacggtaccgtaaccggtccgttaccggtaccgtacggtacggtcgtacgttcgacggtcgtcggtacgtacggacgtacggtacggtacggtacg

SEQ ID NO: 304137 - DNA, 613 bp, Homo sapiens
  misc_feature: GZ8MTXP02FF5PW.4.36.D03.1.454.CMB.2.raw
  modified_base (496)..(496): a, c, t, g, unknown or other
  misc_feature (496)..(496): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactcttcaggctaattcgaacttagcctagaagagtcgaggtctagggtctatgtatttcgtgtgcgtcgggtactttcgtccccggacgacgtgacggtggacagggtatcgatgctagtttgacttagtacgtggggcctaaaggggaccaagttcggtccaaccgtctacttaccaacgaccctaccaacccaaacggtcccctaagtccggttcctaccccgtaggacccgaccttcggctaccgaggacgccaacgtccgagacgcacncgtcggtcctgggcctggtccgtttcgggacctaaacggtaccgtaccgttccccgaaggtacgttcggacctcgtaggaacgtcggtcgttaggtaccaagggcccgtcgaaacgg

SEQ ID NO: 304138 - DNA, 627 bp, Homo sapiens
  misc_feature: GZ8MTXP02JABAV.4.36.D03.1.454.CMB.2.raw
  modified_base (249)..(249): a, c, t, g, unknown or other
  misc_feature (249)..(249): n is a, c, g, or t
  modified_base (262)..(263): a, c, t, g, unknown or other
  misc_feature (262)..(263): n is a, c, g, or t
  modified_base (309)..(309): a, c, t, g, unknown or other
  misc_feature (309)..(309): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaacccaagaactcactctcagctagttcattgcagaagngtgagtctgggtnntctgtgtggtgcgtagtatcgtccgagacgtggagtagtgtagtanacgtactagtatagttacgtcgtgtacggtcggacgtacgtacactcgtaccacgtactaccgaaccgaaccgtaaaccctaccctaaccgtaccttacccttacgtacctaaccttacccgtaacgtaccgaccgtacgacgtaccgacggaaccggaccggaacggtacccggaacgttacgtacgttacgttcgttcggtccgttcggtacgttccgtccgtaccgtacgtaccgtaccggtcggtaccggtagggtcgtacgtcgtagtcgtaaggtccgttaagtggtaacttcgggaccgtaaggtaaccgg

SEQ ID NO: 304139 - DNA, 592 bp, Homo sapiens
  misc_feature: GZ8MTXP02HNBAX.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctttctgcaaatgaacagcctgagagccgaggacacggctatgtatttctgtgctcgggatttccgtccccggacacgtggcggtggcaggggttatggatgctagtttgatagtcgtggggaccaaggggacaagtggtccacgtctctcacgcctccaccgaacggcccagtccggtcctttcccccgtggcccgcccgtcgccctacccgagggaccgccctacccgtccgagacgccgacgacggcccggcccgtgggccgtcgcccgttaggtaccgaaacggtaccttacccgtttaccccctaagtacgtcgtccgttcgtcggaacggccgggtcgtacgggaccaacgggccgacacg

SEQ ID NO: 304140 - DNA, 584 bp, Homo sapiens
  misc_feature: GZ8MTXP02FTLGP.4.36.D03.1.454.CMB.2.raw
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
  modified_base (456)..(456): a, c, t, g, unknown or other
  misc_feature (456)..(456): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaaccccaagaactcacttctttctgacaaatgaacagcctgagagccgaggacacggctatgtatttcngtgcgtcgggatttccgtccccggacacgtgcggtggcaggggtatgatgctatttgatagtcgtggggaccaagggacaagtcggtacaccgtntccttcacgccctaccaccgaacggcccacgtccggtccttccccgtggccctccctgcctccgaaggcgccaccgtccgganacgacaccgacggcccggccgtggggctcggccgttgggtaccaacgggtacccttaccttccccgttaagacggttccgccgttcgtacggaacgggccgggacgtcgggaccgaagggcgactaag

SEQ ID NO: 304141 - DNA, 619 bp, Homo sapiens
  misc_feature: GZ8MTXP02FUJML.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtacaaaggtgaatccagaggctacacaggagagtctcgacgggacccccaggctggaccaagccctccccagactccacaatcgcccctcacactcggactacctactaaaatagacaaacaaacggaaaacccagctacacgacccctaaattcccatcggtgacgtcctctagtcgactcagtcgctgactaccgaaaccgaagttacggggaaaacggtccgtttagggacgtccgaaggggtactaaacgggccttcccgtactccgtagaacgtaccctacccaaccgaaacgggcccctaagtcccggttcccttcccccgtggcccgtcccctgcctccgacggccgcctacccgcgaacgcgaccacgacggccggcccgtgggcctgccgtgtaccgaaggtcctactcccgtactacgg

SEQ ID NO: 304142 - DNA, 586 bp, Homo sapiens
  misc_feature: GZ8MTXP02HVMIX.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactcttctgcaaatgaacagcctgagagccgaggacacggctatgtatttctgtgctcgggatttccgtccccggactactggcggtggcaggggtatgatgcatttgatatcgtggggaccaagggacaagtgggtccaccgtctccttcacgccctaccacaacgggccctagtccggtccttcccccgtggcccgccctcgcctccgaggacgtccaccgtcccgagacgccaccgagcccggcccgtggggccttcggacccgtgggtaccgaaacggtaccttaccttccccgtaacgacgttcgcccttcgtcggaacggtccggggccgttcggggaccgaaacgggccgacgtaag

SEQ ID NO: 304143 - DNA, 636 bp, Homo sapiens
  misc_feature: GZ8MTXP02FJ6MJ.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttctgcaatgaactagcctagaagagccgaggtacacggtctatgtatttctgtgcgtcgggatttccgtccccggacacgtggcggtggacaggggtatggtatgactagtttgattagtcgtggggaccaagggacaagtcggtccaccgttctacttaccaacgaccctacccaaccgaaacgggtccctagtccggttcccttcccccgtggccctaccctgcctaccgaggacgcccgaccgtcccggagacgaccgtacgacggtccggtcccgtggggtcctcggtacccgttacgggtacccgtaaacgggtacccttacccgttcccgtaaacggtacggttcgtacgtccgtaggaacggtcgggtacgttacgggaccgtaacgggccgacgtaaagg

SEQ ID NO: 304144 - DNA, 651 bp, Homo sapiens
  misc_feature: GZ8MTXP02JK8A9.4.36.D03.1.454.CMB.2.raw
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctccagagaccaacccaagaactcactctttctgacaaatgaacagcctgagagccgaggacacggctatgtatttctgtgcgtcgggtactttccgtccccgganacgtggcggtggacgtagggtntgatgctatttgatagtcgtaggggaccaagggactaagtcggtacctaccgttctcttcacgccctacccgaccgacggccctacgtcccggttcccttcccccgtcggcccgtcccgtcgcccgtacccgacgggtaccgacccgtacccgtaccggaacgaccgaccgaaccgaccgggcccgggccccggttcggggcccttccggtcccggttacgggtaaccgtaaaacgggttacccttacccgttaccccgtacgtacggttccgaccgttcgtacggaacgggtccgggccgtacgggaccgacggaccgacgtacg

SEQ ID NO: 304145 - DNA, 553 bp, Homo sapiens
  misc_feature: GZ8MTXP02G2AWY.4.36.D03.1.454.CMB.2.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaaccccaagaactcactcttcagctatcatgctagaagngcgagtctagggtntntntntgtgtgcgtgtctcgccganacgtgngtgngagtatnatatntagtnacgtgtcgtacggacgtagactacgtcgtacacgtactactaccaccaccaccaccgtaccgtacctacgtccgtacctaccgtacgaccgacgtacgacgacgacgacgaccgacgacgacgtacgtacgtacgtcgtccgtcgtggtccgtcgtaccgtacgtaccgtacgtccgtacgtccgtagtacgtcgtacgtcgtacgtgtcgtacgtacgacggtacgtcggtagtacg

SEQ ID NO: 304146 - DNA, 510 bp, Homo sapiens
  misc_feature: GZ8MTXP02F0ZVX.4.36.D03.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (298)..(299): a, c, t, g, unknown or other
  misc_feature (298)..(299): n is a, c, g, or t
  modified_base (302)..(303): a, c, t, g, unknown or other
  misc_feature (302)..(303): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (481)..(481): a, c, t, g, unknown or other
  misc_feature (481)..(481): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcactctcngctatcattgctagaagngtcgagtctgggtntntntntgngtgcgngtntcgcgangngngtgngagnnatnntatnactgtgnggactagacagtctcnctcacacacacctacactacgtcctagtcgtactccgacgcctacgacgacgacgacgacgacgaccgtacgacgtacgtacgtacgtcgtcgtcgtcgtcgtcgtccgtcgtacgtacgtacgtacgtcgtacgtacgtcgtacgtgagngtcgtcgtacgtacgcggacgtacgtacg

SEQ ID NO: 304147 - DNA, 547 bp, Homo sapiens
  misc_feature: GZ8MTXP02GWUMS.4.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctcngctatnatgcagaagngtcgagtactgggtntntntntgtgtgcgtgtactcgaccgancgtgngtgngngtatnatnatagtanacgtgtcgtacggacgacgactacgtcgtcacgtcactaccacgaccaccgacgtacgtacctacgtccgtacctaccgtacgtaccaccgtacgaccgtacgacgaccgaccgtacgacgagtacgtacgtacgtacgtccgtcggtcggtcgtcgtccgtacgtacgtacgtccgtcgtacgtacgtcggtcgtcgtgacgtgtcgtacgtacgacgtcggcgacgtacg

SEQ ID NO: 304148 - DNA, 623 bp, Homo sapiens
  misc_feature: GZ8MTXP02IF3DP.4.36.D03.1.454.CMB.2.raw
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaaccccaagaactcacttctttcngcaaatgaacagcctgagagccgaggacacggntatgtatttcngtgctcggtatttccgtccccgganacgtggccggtggcagggtatgatggctatttgattagtcgtggggacccaaagggacaagtcgggtaccaccgttctcttacgacgtcctacccaccgaacgggcccctacccgggtcccttcccccgtgcccgccccttgccgtccgacggacgacccgacccgtaccgacgacgcgaccgacgcccggacccgtgggccgtcgccgttcggtaccgaaacggtacccgttaaccttccccgtaaacgtacgtcggtccttaccgtacgacggggcccgggaccgttagggaccgaaagggtcccgacgtaacgtaacgg

SEQ ID NO: 304149 - DNA, 628 bp, Homo sapiens
  misc_feature: GZ8MTXP02FZIOA.4.36.D03.1.454.CMB.2.raw
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctcagctatcattgctagaagngtcgagtctaggggtntatgtattcgtggtggtcgtacggtattcgtacccggacgtacgtggacggtggtacgtaggtatcgtacgtagtacgtattcgtacgtgtacggtcggggaccgtacggacctaagtcgtcctaccgtacgtaccgtaccgaacgaccctacctaaaccgtaacggttccctaagttccgtacccttacccgaggccgtacccttaggacctacgacggacgaccgaccgtacggaacgtacgtacgtacttacggtcggtcccgtagggttctcggtacccgtcggtaccacggtactccgtacggtcgtaggtcgtcgcgttgaacggtcgtacgtacggtctacggggtcacggttaacg

SEQ ID NO: 304150 - DNA, 698 bp, Homo sapiens
  misc_feature: GZ8MTXP02FNNM4.4.36.D03.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaaccccaagaactcactcttcngctaatnaatgcagagagcgaggtcaggtntatgtattcgnggtgcgtcggtacttccgcccggatacgtggacggtggacgtagggtntacgtagtctacgttagtttagacgttaggtcggtacggggacgtaacggggtaccaaagtttccgggtacctaacccggttctaccgttaccaacggtacccctaccgaaacccgtaacggtccccctacgttacccggttacccttaccccggtacgccccgtaccgtacgtcgtaccgacggtaccggacccaccggtaccggaacgtacggtaccgtaacggtccggtccggttacccgggtcggtcggttaccggttcccggttacgggtaacccgtaaccggttacccgttaccggttaccccgttagggacgtttccggacgttccggtaggcggtcggggtactacggggacgtacgggcgtaacgtagg

SEQ ID NO: 304151 - DNA, 564 bp, Homo sapiens
  misc_feature: GZ8MTXP02HG5AB.4.36.D03.1.454.CMB.2.raw
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagaccaacccaagaactcactctcaggctagtcattgcagaagngtgagttctggggttntntntgtgtgtgcgtacgtacgtcgcgagagtgagtagagtaganatatatagtagtgtcgtagtacgtcggtacgtacgactactctactacactacaccacgacctacactactctactactactacgactacgacacgacgacgacgacgacgacgtacgtacgtacgtacgtacgtacgtcgtacggtacgtcgttcggttaccgtacgtaccgtacgtaccggtacggtcggtacggtcggtacgtacgtacgtagtaacgtgtacgtacggtacgtacggtacggtacggtacg

SEQ ID NO: 304152 - DNA, 639 bp, Homo sapiens
  misc_feature: GZ8MTXP02F7TYO.4.36.D03.1.454.CMB.2.raw
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttcngtgctcgggtatttcgtccccggacacgtgcggtggcgagggtntgatgctatttgatatcgtggggaccaaggggacaagtcggtcaccggtctccttcacgtccctccaaccgaacggggcccctacgtccgggttcccttccccccgtcgggcccgtccccgtcgcctacccgagggaccgcccacccgtcccggaagacggccaccgacggcccggcccgtgggggtccttcggcccgttcgggtacctaaaacgggtacccttacccgtttacccccgttaaacgacggttccgccgtttccgttacggaaccggggtcggggtcgtacggggaccgtaaacggggccgaccgtaagg

SEQ ID NO: 304153 - DNA, 668 bp, Homo sapiens
  misc_feature: GZ8MTXP02IPNFA.4.36.D03.1.454.CMB.2.raw
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtgccaacattcggcgagatggaattgtgacacactatatggactctgtggagggccattcaccatctccagacgaccaaccccaagaactcacttctttcngacaaatgaacagcctgagagccgaggacacggctatgttatttcngtcgtcgtcgggtactttccgtccccggatcgtggcggtgcagggttatgatgctagttttgacgttacgtcgtcggggaccaaaggggacctaaggttcgggtaccctacccggttcttaccgttaccgacgtccccttacccgaaaccgacgggtccccctaagttcccggttccctttcccccgnggccccgtcccttgaccctaccgacggacncccgtacccgtccggagaccgaccgaaccgcgggccccgtacccggtggggacccttcggtaccccgttagggaccgtaaacgggtaccttaaccttcccgtaaacgcgttccggacctttcgcggaaccggccgggtaccgtacggggaacctaacggggccgtaacgtag

SEQ ID NO: 304154 - DNA, 549 bp, Homo sapiens
  misc_feature: GZ8MTXP02HQ34T.4.36.D03.1.454.CMB.2.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (422)..(422): a, c, t, g, unknown or other
  misc_feature (422)..(422): n is a, c, g, or t
  modified_base (449)..(449): a, c, t, g, unknown or other
  misc_feature (449)..(449): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactctttcngacaaatgaacagcctgagagccgaggacacgctatgtattcngtgcgtcgggtatttccgccccgganacgtggcggtggcgtagggtatgatgtactagtttgacttagtcgtggggaccaagggactaagtcggtccacgtctctcacgccctaccacaacggcctacgtccgtccctccccgtgcccncctgcctcgagcgccaccgtcgagacncgacacggccgccgtggcctcgtccgtggtaccaacgtcccttaccgttacccacgacgtcgctaccgtgaacggtcggacgtcggacacgggcacgtag

SEQ ID NO: 304155 - DNA, 719 bp, Homo sapiens
  misc_feature: GZ8MTXP02IGA39.4.36.D03.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagagcactgtagcacgaccggtgctcgatttagctgcgtcacgatctctcctgtgtagcctctggattcacctttgacacctattggatgacctgggtccgccagtctccgagggaagggctggagtgggtggccaacattcggcgagatggaattgtgacacactatatggactgtgtggaggccgattcaccatctcagagaacaacccaagaactcactcttcagctagtnatgcagaagngngagtctaggtntatgtntgngtgcgtcgattcgtaccganacgtaggcgtagacgtaagtntacgatagactagttgtagtacgttcgacgggtacgtaacggactacgttcgtaccgtacttacgtacttaaccgacgtaccctaaccgaaaccgtaacggtacccttaagttccgtaacccgtttacccgaacgggttacctacccgtaagtaccgtaccggaaacggtacgtaaacccgacccgttaacggtaaccgaacgtttaccgaacccggtttaagggtccccgtttaaaccggccggggttaacttaccgggtccccggttttaaccggaacccccgggtttaacggtaaaacccccggtttcggtttaaaacccccgggacgggttaacgtaccgtacggttacggacggtaacgggttacgttaacggtcggtaaaacggttaccggtacgtaacggacg

SEQ ID NO: 304156 - DNA, 573 bp, Homo sapiens
  misc_feature: GZ8MTXP02IUBDK.4.36.D03.1.454.CMB.2.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (529)..(529): a, c, t, g, unknown or other
  misc_feature (529)..(529): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaacccaagaactcactcttcagctaatcgattgcctagaagngtcgaggtctcgggtntatgtattcgngtcgcgtcggattcgtcccgganacgtggcgtggactagggtatgatagtctaattgacgtagtcgtacggggactaacgggtacctaagtcggtacctaccgtctacctaccgaacgacctaccaacgtacgtccctatccgtaccttacccgngaccnctcgacacgacgcgaccncgtacgcgacncgtaccgtgcgtccgtggtactcggtaccgtcgtacgtaacggtcgtaccgttccgaacgntcggtctcggtagcgtcggtacttggaccgaggtaccgagtaag

SEQ ID NO: 304157 - DNA, 588 bp, Homo sapiens
  misc_feature: GZ8MTXP02HCBEZ.4.36.D03.1.454.CMB.2.raw
  modified_base (233)..(233): a, c, t, g, unknown or other
  misc_feature (233)..(233): n is a, c, g, or t
  modified_base (463)..(463): a, c, t, g, unknown or other
  misc_feature (463)..(463): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactcgtgtggagggccgattcaccatctccagagaccaacccaagaactcactctttcngacaaatgaacagcctagagacgccgaggacacggctatgttatttctgtgcgtcgggtactttccgtccccggactacgtggcggtggcgtagggtatgatgctatttgattagtcgtggggaccgtaaggggactaagttcggtacctaccgttcttcgttcacgccctacccgaccgacggcccacgtcccggtcccttccccgtgcccgcctcgcctccgaggacnccaccgcgagacgccacgcggccggtcccgtcgggctcggtccgtcggtaccgtaaacggtaccttaccgttccctaacgcgttcgccgttcgacggcggtcggcggtcggacgacggcgacgag

SEQ ID NO: 304158 - DNA, 682 bp, Homo sapiens
  misc_feature: GZ8MTXP02JUL0S.4.36.D03.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcacatctccagagaccaacccaagaactcactcttcngacaatnaanagctagagagcgagcacggntatgtattcgngtgtcgtcggtacttccgcccgganacgtggcggtggcgtagggtatgatgtactagttgacgtagtcggtacggggaccgaagggtactaagtcgggtacctaccgttaccgttctaccgaccgtaccctacccgaaacccgtacggtaccctacgttcccgttacccgttcccccgtaggccccgtacccgttcgaccgtacccggacgggtaccgccccgaacccggtaccggaacgaccggtaccgaaccgtccggggtccccggtcccggtcgggtccgttccggtcccggtacgggtaacccgtaaccgggtaccctttacccggtaccccgtaaaggtcggttcgtaccgttacggtacggaacggggtccggtacggtacggtacgaacggtccggaataacgg

SEQ ID NO: 304159 - DNA, 544 bp, Homo sapiens
  misc_feature: GZ8MTXP02H2DTM.4.36.D03.1.454.CMB.2.raw
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (520)..(520): a, c, t, g, unknown or other
  misc_feature (520)..(520): n is a, c, g, or t
  modified_base (543)..(543): a, c, t, g, unknown or other
  misc_feature (543)..(543): n is a, c, g, or t
tcagagcactgtagcacgaccggtgctcgatttagctgcgtcacgatctctcctgtgtagcctctggattcacctttgacacctattggatgacctgggtccgccagtctccgagggaaggggctggagtgggtggccaacattcggcgagatggaattgtgacacactatatggactctgtggaggccattcaccatctccagagaccaacccaagaactcactctnagctgttcattgctagaagagtcgagttctgggttntntgtgtgtgngngtcgtgtcgtcgngagtgagtgtgtagtatatatagtagtagtacgtcgtacggtcggtacggtacgtacgtcgtacgtcgtacgactaccgacctaccacacctaccactacctcttacgtcttaacncgtacgacncgtacacgngacgacgacgacgtacgcgtagtcgtacgtcgttgtcgttgtcgtccgtacgtccgtacgtcgtacgtcgacgtagtcgtacgacgtgcgtaagtntacgtcgtagtacgtacgtacgng

SEQ ID NO: 304160 - DNA, 633 bp, Homo sapiens
  misc_feature: GZ8MTXP02I051I.4.36.D03.1.454.CMB.2.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaaccccaagactcactcttctgcatnatagctagaagagtcgaggtactaggcgtntgtagttctgtgcgtcggagttcgtcccggacactggcggtggtcgaggtagtgactgtcgtatttgtacgtagtgtcgggacgtaggacgaatcggtcaccgtcgtacctccaacgcctaccaccgacgtacctacctacgtccgttcccgttacgcccgtaccgtccgtaccgtacgacggacgacgacccgtaccgtacgacgtaccgtacgtaacgtcggtcccgtcgggtcggttccgtacccgtccggttaccgtaaccggtacggttaaaaaccggtttcccgtaaccgtaacggtacgtaccgtaccgttggaacggtcccgggtaggtcccggttagtaacgggtcggaccgtaaacgg

SEQ ID NO: 304161 - DNA, 597 bp, Homo sapiens
  misc_feature: GZ8MTXP02JTEM0.4.36.D03.1.454.CMB.2.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
  modified_base (576)..(576): a, c, t, g, unknown or other
  misc_feature (576)..(576): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactcttngactaatnactgctagagagcgagacnggctntgtatcngtgcgtggtacttcgcccganacgngaggtgacgaggtatgtatgctagttgacgtgtacggtcgggaacgaggtactagtcggtacnccgtctcctacgacgtacccgtaccaaacgtaccggtccacgttaccggtccctaccccgacggcccgtaccgtcgaccgtacccgaacggtaccgacccgtacccggtacgaaaggccctacgttaaacccgcggtcccggtccgttggcccgtcgtaccgttacggaccgtaaccggtacctacccgttcccgagtacgtcgtacgtcgaggtcggcgngtacggacgacggctacgaag

SEQ ID NO: 304162 - DNA, 665 bp, Homo sapiens
  misc_feature: GZ8MTXP02JXQFP.4.36.D03.1.454.CMB.2.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccattcaccatctccagagaccaacccaagaactcactcttcngcaatgactgctgagagcgagacacggctatgtattcgngtcgcgtcgggtatttccgtcccgganacgtgacggttggacgtagggtactggactagctaatttcggattagtcggtaggggaccaagggactaagtcgggtacacccgttctaccgttcaacgtccctaacccgaaacccgtaaacgggtccctaacgttcccggttaccccttacccccgtaggtaccccgcccttacgacccgttaccgacgggaacgcccaaccgtcccggaagaaccgcgtaaccgcggtccggacccgtcgggtccttacggtcccgtacgggtaccgtaaacggtacccttaaccggttccccagttacgttcggcccttaggtacgtaaccgggccgggttcgtacgggtaccgtaaccgggaccggtaacgtaacg

SEQ ID NO: 304163 - DNA, 776 bp, Homo sapiens
  misc_feature: GZ8MTXP02HFJGT.4.36.D03.1.454.CMB.2.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttcngcatnatgcngaagagcgagactacggctatgtattctgtgcgtcggatttcgtcccganacgtgcggtgcgagggtatgatgctatttcgatagtcgtacggggacgaaggacctaagtcggtacctaaccggtcctaccttaccgaacgaccccgttaacccaaacccgtaaaccgggtacccccttaaacgttcccgggttacccctttaccccccgttacgggtaccccgtaccccctacgggtacccttacccgaacgggtaacccgacccgttaaaccccggtaccccgggtaaacggaccggtaaccccgtaaaccggttaacccggtacccggggtacccccggtttacgggggtcccgtttaaccgggtcccccggtttaccggggttaaccccggttaaaaccggggtacccccgtttacccgttcccccgggttaaacggtaacgggtttccggtacccgtttcggacgggttaacggggacccggggttcttaccgggggaccgttaaacggggccccggttacggtaaacgg

SEQ ID NO: 304164 - DNA, 594 bp, Homo sapiens
  misc_feature: GZ8MTXP02IW62G.4.36.D03.1.454.CMB.2.raw
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactcttctgcaaatgaacagcctgagagccgaggacacggctatgttatttctgtgcgtcgggtatttccgtccccggacacgtggcggtggcgtagggtatgatgctatttgactagtcgtggggaccaagggacaagtcggtacaccgtctcttcacgccctaccaccgaacggccctagtccggtcccttcccccgcggcccgtccctcgcctacccgaggacgcccaacccgtccgagacgccaacgcggcccggtcccgtcggggcctcggcccgtgggaccgtaaacgggtcccttaaccgttcccctagtacggtcgccgtccgtggaaccggtccggggtacgtcgggacgaacggcgacgag

SEQ ID NO: 304165 - DNA, 713 bp, Homo sapiens
  misc_feature: GZ8MTXP02FH511.4.36.D03.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccgattcaccatctcagagacaaccccaagaactcactcttcngctaatgaactgcngaagngcgagtacncggtntatgtattntgtgcgtcggattccgcccgganacgtggacggtggcgtagggtactaggtaacttcgactagttttcgagttacggttccgtaggggacccgtaaaggggtaacctaacggttccgggttacccaaccccgggtttacttacccgttaaccgaaccggaccccttaaccccgaaacccgtaaacccgggtaccccctaacgttcccggtaccctttacccccgttacggacccgtaccctcgaccgtaccgacgggtaccgaccgaaccgtcccgggaagccggtaactaccggacgttccgggtaccctcgggggtaccttcggcccgtttacggtacccgtaaacggtacccgttacccgtttacccggacgttacgggtaccgttcgtaccgttggaacggtcggttaccggaggtcgtaacggggccgacgtaaacgg

SEQ ID NO: 304166 - DNA, 597 bp, Homo sapiens
  misc_feature: GZ8MTXP02F40DZ.4.36.D03.1.454.CMB.2.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (595)..(595): a, c, t, g, unknown or other
  misc_feature (595)..(595): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagaccaacccaagaactcacttctttctgacaaatgaacagcctgagagccgaggacacggctatgtattcngtgctcgggtatttccgccccggancgtgcggtggcgtagggtatggatgntagtttgatagcggtaggggaccaaggggaccaagtcggtaccaccgttctcttcacgccctaccgaaccgaacgggccctacgtccggtccctttcccccgtcggcccgtccccgtgccctccgacggaaccgccctacccgtacccgagacgaccgaccgtacgccggcccgtggggcctcggtccgtgggacaacgggtaccttaccgttacccctagtcgtacgtccttcgacggcggtccgggcgtacgggacaacggccganag

SEQ ID NO: 304167 - DNA, 647 bp, Homo sapiens
  misc_feature: GZ8MTXP02FUGI5.4.36.D03.1.454.CMB.2.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtgccaacattcggcgagatggaattgtgacacactatatggactcgtgtgggaggccgattcatcatctcagacgaaccaacccaagactcacttctnagactgtacattncagaaagngngaacgttctgggtnntntctgtgtgtcggtatcggtaccgtacgacgtacgaggtacgtgaagggtatacgtaacgtagtacgtaaagttgtaacgtaccgttaggtacgggttacgacggtacgtacgtcgggtacctaccggttcaacgttccaaaacggacccaaacaaacccgaacggtaaccctacgtactacgttaccctagttacgaactacacgtaccgaggaacgacgaaccgacgaccgggaaacgacgtagtacgttcgttacgtggtacgtcgttccggtacgtaccgtacgtaccggttaccgtaccggtacggtacggttacggtacgtacggtacggtaaggtacggtacggtacgtacgtacggtacggtacggtacgg

SEQ ID NO: 304168 - DNA, 676 bp, Homo sapiens
  misc_feature: GZ8MTXP02IVBRS.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagcccccttccctggagactggccggacccaggtcatccaataggtgtcaaaggtgaatccagaggctacacaggagagtctcacgggaccccccaggctcggaccaacgccctcccccagacctccaccaacttcgcccctcacactgaccaccttacaaaatacacaaacaaacggaaaacccagctacacgaccccaattccagtggtacgacgttccctcctgtacgcctcgagtcgctgactacaaaccgaaggtacgggaaacggtccgttagggacgtaccgaggggtacgtaacggccttccgtcctcctacggaccgtaacccctaccgaaccgaaacggggcccctaacggttccccggtttccctccccccgtcgggccccgtccccgtacggcccgtaccgacggtacccacccgtacccgccggaacgccgaccacggaccggcccggtcccggtggccctacggaaccgtacggtcggtaaccggaacgtacccgttaaccctttacccgtaaacgg

SEQ ID NO: 304169 - DNA, 728 bp, Homo sapiens
  misc_feature: GZ8MTXP02GWUAC.4.36.D03.1.454.CMB.2.raw
tcagagcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcgacgggacccccaggctcggaccaagccctccccagacctccacccaatcgcccctcacactcgaccaccttactaaaatacgacaaacaaacggaaaacccagacctaccacgacccccaaacttaccagtggtgacgtcctccgtgtcgtctactagtgctgactacaaccgaaaggtacgggaaacgggtccgttaggggaacgttcccggaaggggtaccgttaaacggggcccttacccgttcgtaccgtacggaaccgtaacccgtaccccgaaacccggaaacgggggccccctaacggttccccgggttcccctttaccccccggtcggggccccgtcccccgtcggtacccgttacccggacgggaccgacccgaaccccgtcccgggaacggaccggaccgaacccgaccgggcccgggccccggtcgggcccgtccggtcccgtcgggtaccgtaacgggtacccttacccgttaccccgtaacgtaccgg

SEQ ID NO: 304170 - DNA, 667 bp, Homo sapiens
  misc_feature: GZ8MTXP02I6TXH.4.36.D03.1.454.CMB.2.raw
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
tcagagcactgtagcacgaccggtgctcgatttagctgcgtcacgatctctcctgtgtagcctctggattcacctttgacacctattggatgacctgggtccgccagtctccagggagggctggagtgggtggccaacattcggcgagatggaattgtgacacactatatggactcgtgtggaggccgattcacatctccagagaccaacccaagaactcacttcttcagactaattnaatagcctagaagagcgagactacggntatgttattcgtgtgtcgtacgggtacttccgtacccgagtacgtggcggtaggacgtagggtatagagtatactagtttagacttagtcggtacggtaacggtaacggaacgtaacgttcggtaccctacgttaccgttacctacgaaccgtacctaaccccgtaaaccgaccggtaaccccgtaacgttcccggttaacccgttccccgttacgccccgtacccgttcgtacccgtaccgaacggacgtaccccgaacgtaccggaacgaaccgaccgaacgaccgtccggtccgtcgggtcgttcggtaccgttacggaccgtaacgtacccgttaccgtacccgtaagtacgtacgtgtaccgtaggaacggcgtacgacgagaacgtccggaatagg

SEQ ID NO: 304171 - DNA, 596 bp, Homo sapiens
  misc_feature: GZ8MTXP02IK7WB.4.36.D03.1.454.CMB.2.raw
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactcttcngacaaatgaacagcctgagagccgaggacacggctatgttatttctgtgcgttcgggtatttccctccccggacacgtggcggtggcgtagggtntgatgctaatttgattagtcggtggggaccaaagggacaagtcggtccacgtcttcttcgacgtccctcccaaccgaaccgccctacgtcccggttacccttcccccgtcgggccccgtccccgtcgtacccgtacccgacgggtaccgccctacccgtccggaagacgccgacgacggcccggccgtcggctcgccgtgacgacgtacttaccctccacgtacgtcgtccgtcgtacggaacggccggtcgtcggaccgacggccacgtag

SEQ ID NO: 304172 - DNA, 628 bp, Homo sapiens
  misc_feature: GZ8MTXP02FJBF7.4.36.D03.1.454.CMB.2.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (610)..(610): a, c, t, g, unknown or other
  misc_feature (610)..(610): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcactanactccacgagacgaacccaaaccgaactaccactcttctcgacgaactgtacagttcncgaagaagcgaggacgtacgtcggtatgtagttctgtgtcgtcggtacgttaccgtccgacgtacgtggtacggtcgtagtaggtctagtagtcgactagttagagtcgtacgtcgggtacgaggactagtcgcctactctccgtacacgaccctaccgaaaccacggtaccctacgttaccggttacccttccccgaggaccccttacccgtagaccctacggaaccggacgacccggaaaccgtcggaagacccgtacgtaccgtcggtaccgtcgttacgggtctccggtccgttacggacgtacgtcccgtacgttacccgagcgttcgagtacgtggaacggtgtacncggatacggcgtacaagg

SEQ ID NO: 304173 - DNA, 599 bp, Homo sapiens
  misc_feature: GZ8MTXP02GZMSY.4.36.D03.1.454.CMB.2.raw
  modified_base (302)..(302): a, c, t, g, unknown or other
  misc_feature (302)..(302): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactctttctgacaaatgaacagcctgagagccgaggacacggctatgtatttctgtgctcgggtactttccgtccccgganactggcggtggcagggtatgatgctatttgatagtcgtggggaccaaagggacaagtcggtccaccggttctcttcacgtccctacccaaccgaacggcccacgtccggtcccttcccccgtggcccgccctcgcctaccgacggacgccgaccgtaccggagacgaccgacgacggccggcccgtcgggcctcgtccgtacggtaccgtaacgggtacccttaaccgttccctaacgtacggtcgtccgttcgtacggaacgggtcggccgtacgggaccgaacggccgacgtacg

SEQ ID NO: 304174 - DNA, 676 bp, Homo sapiens
  misc_feature: GZ8MTXP02JBQ0A.4.36.D03.1.454.CMB.2.raw
  modified_base (349)..(349): a, c, t, g, unknown or other
  misc_feature (349)..(349): n is a, c, g, or t
  modified_base (482)..(482): a, c, t, g, unknown or other
  misc_feature (482)..(482): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttcgtgtgccgtcgggtactttccgtcccccggactacgtggccgggtggcgtaggggtactggatgactaagtttnaattagtccggtaggggtaaccaaggggacctaaagtcgggtacctaccggtcttccttacgacgtccctaccaacccgaacggccccacgttccgggttcccttcccccgtcggccccgtacctcggtaccnccggaaggtaccgtccaccccgtcggacgacgaccgaccgtacgggcccgggccccgtgggggtccctcgggtacccgtcgggtaaccgaaaaccgggtaccctttaccccgttacccgtaaacgtacggttccggcctttccggacgggaacggttcccggggacgtcgggggaaccaacgggggctacaagg

SEQ ID NO: 304175 - DNA, 608 bp, Homo sapiens
  misc_feature: GZ8MTXP02GINES.4.36.D03.1.454.CMB.2.raw
  modified_base (284)..(284): a, c, t, g, unknown or other
  misc_feature (284)..(284): n is a, c, g, or t
  modified_base (442)..(442): a, c, t, g, unknown or other
  misc_feature (442)..(442): n is a, c, g, or t
tcagagcactgtagcacgaccggtgctcgatttagctgcgtcacgatctctcctgtgtagcctctggattcacctttgacacctattggatgacctgggtccgccagtctccaggggaaggggctgggagtgggtggccaacattcggcgagatggaattgtgacacactatatggactctgtggagggccgattcaccatctccagagaccaacccaagaactcactctttctgacaaatgaacagcctaggagacgccggaggacaggctagtgtatttcgngtcgcgttcgggtactttccgccccggatacgtggcggtggcgtagggtatggatgctagtttgattagcggtaggggaccaagggactaagtcggtccaccgtctcttacgacgtccctaccaaccgaacggccctacgtccggttcccttccccgnggcccgtccctcgcctccgaggaccgccaccgtccggagacgaccgacgacggccggtcccgtcgggcctcggtccgtagggtaaccgtacggtaccttaaccgtcccgtaagtacgtcgtcccgtcggtacgcgggtcgggacgtcggacgaacgggccacgtag

SEQ ID NO: 304176 - DNA, 771 bp, Homo sapiens
  misc_feature: GZ8MTXP02GRZKA.4.36.D03.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggcgattcacatctccagagacaaccccaagaactcactcttcagctatnatgcagaagngcgagtctacggtntagtgtnttcgtgtgcgtcggtacgttcgtcccgatacggtagacggtaggtacgtaggtagtacgtatacgtagtattacgtagtacgtacggtacgggtacgttaacggaccgtaacgttccggtacctaccggtaccttaccgtaacccgacgtaccctaacaaacccgtaaccgggacccttaccgttacccgttaacccttaacccccgggttaacgtaacccggttaccctaacggaccgtttaaaccggaccggtaaacgaaacccggacccgggttaaaccggtaagggtaacccgaccggttaaaacggggtcccgttaccggggtaacccgtttacggggttccccgtttaaccgggtaccccgggtttaacgggaaaccccgttaacccggggttaaaacccctttcccggggtttaaaacccggcggttaaacggttccggacgtaaacggcggtaaacggtccgtaggtaaccgtacggtagaaccggttagtaaacggg

SEQ ID NO: 304177 - DNA, 630 bp, Homo sapiens
  misc_feature: GZ8MTXP02JUC3Y.4.36.D03.1.454.CMB.2.raw
  modified_base (266)..(266): a, c, t, g, unknown or other
  misc_feature (266)..(266): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcatcatctccagacgaccaacccaagactcactctcagctgtctagttcgacagaagacgtgagttcgtgggtntgtcgtcgtgtggtcggtcggtacgtacgtaccgacgtacgtagtacggtagtaggtagtagtacgacgtatacgtagtacgtacgtcgtcggtacggtacggtacggtacgtacgtccgtaccgtacctaccgtacgtaccgaacccgaaacccaacccgaaccgtaaccgtaccttacctccgttacgtaccctacggtactacgtacgactacgacgacggacgaccgacgagtacgtacgtacgttcgtacgttcgtcgtcggtcgttccgtaccgttaccgtacccgtacgtccgtacggttacggccgttaggtaccgtggtagtcgtaggttacgtagtacgtaggcgtaacgacgg

SEQ ID NO: 304178 - DNA, 603 bp, Homo sapiens
  misc_feature: GZ8MTXP02I7YQQ.4.36.D03.1.454.CMB.2.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (294)..(294): a, c, t, g, unknown or other
  misc_feature (294)..(294): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcaccatctccagagacaacccaagaactcactctcngctatcatgctagaagngcgagtctacgggtntntntntgtgtgcgtgtctcgaccgagacgtggnggtagacgtaggtatagtatacgtacgtagtgtacgtacgtcggtacggtacgtacggacgtacgtccgtacctacgtaccgtaccgtaccgacgtaccctaaccaaccgtacgtaccctacgtaccgttacccgtacccgtagtacccgtaccgtacgaccgtacgacggaccgaccgaccggtacgacgacgtacgtacgtcggtccgtcgtcggtcgttacgtaccgtacgtaccgtacgtaccgtaccgtacgtagtcggtcgtacgtcgtagaacgtcggacgtacgacgacgtacgacgtacg

SEQ ID NO: 304179 - DNA, 561 bp, Homo sapiens
  misc_feature: GZ8MTXP02GU44O.4.36.D03.1.454.CMB.2.raw
  modified_base (233)..(233): a, c, t, g, unknown or other
  misc_feature (233)..(233): n is a, c, g, or t
  modified_base (278)..(278): a, c, t, g, unknown or other
  misc_feature (278)..(278): n is a, c, g, or t
  modified_base (322)..(322): a, c, t, g, unknown or other
  misc_feature (322)..(322): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaaccccaagaactcactctttcngacaaatgaacagcctgagagccgaggacacggctatgtatttcngtgctcgggtatttccgccccggacactggcggtggcagggtangatgctatttgactatcgtggggaccaagggacaagtggtcaccgtctctcacgcctccaccgaacggcccagtccggtccttcccccgtcggccgccctcgcctaccgaggacgccaccgtccgagacgacacgacgccggtccgcgggctcgcgtcggtacgaacggtaccttaccttaccctaacgacgtcgcgtcgtggaacgggtccgggacgtcgggaccgaacggccgacag

SEQ ID NO: 304180 - DNA, 764 bp, Homo sapiens
  misc_feature: GZ8MTXP02HS1EV.4.36.D03.1.454.CMB.2.raw
  modified_base (271)..(271): a, c, t, g, unknown or other
  misc_feature (271)..(271): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagaccaaaccccaagaactcactctcaggctagttcattgctagaaagagtcgagttcttggggtntatgtattgtggtggtcggtaggacgttccggttacccggacgacgtaggacgtaggtacgtaggtagtacgtagtacgtacgtagttacgtagttacgtacgtcggggtaccgtaaggtacgtaacgtcggtcctaaccgtacttacgtaacccaacctaacccaaccgaaaccctaaccgtacccgttaacctacccggtacccttaacccgtaacgtaaccgtacccgtacgttaacccgtaccgtaacggaaccggtaaccggtaacccgggtaaaccggtaaccggacggtaaccggttaacgtaaccgggttaccggttaccggttcggggtttaacgtacccggggtttcccgttaaccggggttacccgtaaccggggtttacccgaccgggtttcccggaaacgggttcgggtaacgtcggttaaccggggtacggtaacggtacggtacgttacggtacgtacggtaccggtaacggtaacgg

SEQ ID NO: 304181 - DNA, 611 bp, Homo sapiens
  misc_feature: GZ8MTXP02J0WK1.4.36.D03.1.454.CMB.2.raw
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccattcaccatctccagagaccaacccaagaactcacttcttctagctaattcgattagctagaagagtgagtctacggggtntntntnttgtgtgcgtaggtcttccgcgagcgtggaggtgacgtaggtatagatagtatagtgtacgtgtcggcggacgtaggacacgtcgactactctacaccacacctactacgtacgtactcttccgtacccttcgcgtacccgcgtacgtacgtacgacgtaccgtacgtaccggacgtaggcgtaccggtacgtccggtccggtacccgggtttccgggccgttacccggttacggtaacccccgtaacgggttaccttccggtacccggtagtaccggttcgcggtacgtgggtaccgtcggtacgcggtacggtacggtacgtacggtacgtacg

SEQ ID NO: 304182 - DNA, 610 bp, Homo sapiens
  misc_feature: GZ8MTXP02G2NSZ.4.36.D03.1.454.CMB.2.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagagcactgtagcacgaccggtgctcgatttagctgcgtcacgatcctctcctgtgtagcctctggattcacctttgacacctattggatgacctgggtccgccagtctccgagggaagggctggagtgggtggccaacattcggcgagatggaattgtgacacactatatggactctgtggaggccgattcaccatctccagacaccaacccanaactcactctngctatcatgcagagngcgagtcgtggtntgtntcgtgnggtcgtcgtcggacttccgaccggtancgtaggacggtagacgtagtactatactacgtatacgttgtacgttcgtcggtaccgggacgtaacggtctacgtccgtactccgtaccacgtaccgaaccaccaaaccaccgtcgacccttagtaccgtacctaccgtcgtaccgcccttggacccgagacggaggcccaaaccggtcggtaacgcttacgttaacgccgttcgcccggtgtaccgttacggacccgtggtaacgttaacccggtcgttaccggtaccttacggggagtcgtacgtggtacgaagttccgggtacacggtacgcgtacggactacg

SEQ ID NO: 304183 - DNA, 689 bp, Homo sapiens
  misc_feature: GZ8MTXP02I8T5G.4.36.D03.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactcgtgtggagggccgattcatcatcctcagacaaccaacccaagaactcacttctcgacggacttgttacagttcgacgaagaaagagtagagttcgtagggtntgtntcgngtagtcgtggtacgtacgtaccggacgtacgtacggacgttaggagttaacgggtataggtactatactaagttaggtaaccttagtacggtacgggtacggtacgggtaactacggtcgtacctacggttcctaaccgacgtaaccgacccaaacgaaccaaccgtaaccttactaccgtaccgtttacgacgtacctacgacgtaaccacgtacgaacgaccggtacgacgggtacgaaactaccgggttagtaccgtagttacccggtaggttaccgtcgttccgttaacgcccggtttaaccgtcgtaaacccgttcgggtaaacccgtggggtaacgtccggttaggtacgtaacgtggaccttaggttaaacgtcggtaaggttaccgtaaacggg

SEQ ID NO: 304184 - DNA, 669 bp, Homo sapiens
  misc_feature: GZ8MTXP02HG35U.4.36.D03.1.454.CMB.2.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccattcaccatctcagagacaacccagaactcactcttcagctagtnaattgctagaagngcgagtctgggtntatgtnttcgngtggctggtacttccgtccgancgtaggcgtaggtgtacgggtatcggaatcgtactattcgagttagtcggttacggggactaaggtacctaacgttcggtacctaccggtcctaaccgttacccgaacgaaccctaaccgtaaacccgtaaccggtacccttaccgtacccgttaccctaaaccccgttggaaccctacccggtacttaccgaccggtaaagacccgaacggtaaccgaccggtaacgaaccgtacgtaaaccgtcggtcccgtacgtcgggttccgtacggtccggtacggttacccgtaaaccggttaccgtcccggttacccacgggttacgacggtacgttccggagtcggtacgtcgtacttaaggccgtacgttaacgagg

SEQ ID NO: 304185 - DNA, 803 bp, Homo sapiens
  misc_feature: GZ8MTXP02HMFVQ.4.36.D03.1.454.CMB.2.raw
  modified_base (227)..(227): a, c, t, g, unknown or other
  misc_feature (227)..(227): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcacatctccagagacaacccaagactcactcttcngcaatgaatgcctagaagacgtcgaggtacgtacggtctattgtatttcgtggttaggccgttacgggtactttccgtaccccggactacgttcggaccggtggggtaccgtaaggggttacgtacgtaagttacgtacgttaagtttttacggacctacggttccggggtacgggggtacccgaaaagggggtaccctaaaggttccggggttaacccctaaccggtttacccgttccgttaacccgtaaccggaacccccttaccccggaaaccgtaaacccggggtccccttacgttcccggttccccttttaacccccgcggtaccgtacccccgttcgaacccggttccccgaaagggacccggtacccgtaaccccggtaccggggtaacgtaccggacccgttaacgtcccggggttccgggttaccccgtgggggttcctttccgggtaacccgttcgggttaaacccggtacgggttaaaccctttcccggttaaaccggtctacggggtctaccgttcgttcggaacggcggttacgtacggaccgtttaaggccgtttaacgagg

SEQ ID NO: 304186 - DNA, 606 bp, Homo sapiens
  misc_feature: GZ8MTXP02HH2R2.4.36.D03.1.454.CMB.2.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaacccaagaactcactctnagctagtcatgcagaagngtcgagtctaggtntntntntcgtgtgngtggtatcgtccgagacgtgacggtgtacgtaggtacngtatagtactagtatcgtagtcgtcggacgtaggacctatcggtactacgtacgtactaccgacgaacctacccaaccgtaacgtaccctacgtacgtacccttacccgtagtaccgtaccgtacgaccgtacgacgcgaaccgtacgtacggagacgtcgaacgttcgtcgtccgtggtcgtccggtccgtacggtaaccgtacggtacccttacgggtccctagggtacgtacggtaccgtcgtaagggcgttaccggtacgttagtacgttacggtacgtaacggtacggg

SEQ ID NO: 304187 - DNA, 699 bp, Homo sapiens
  misc_feature: GZ8MTXP02FN81E.4.36.D03.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagagcactgtagcacgaccggtgctcgatttagctgcgtcacgatctctcctgtgtagcctctggattcacctttgacacctattggatgacctgggtccgccagtctccgagggaaggggctggagtgggtggccaacattcggcgagatggaattgtgacacactatatggactctgtggagggccgattcaccatctccagagaccaaccccaagaactcactcttcngctatnatgcngaagngcgagtcaggctatgtattctgtgtcgtcggtattccgtcccgganacgtggaggtggacgtagggtatagatgtactagttagacttagtcggtcggggaccgtaacggggtactaacgttcggtacccgtacgttcgtacccgttacgaaccgtaccctaacccgaaacccgaaaccggtcccctaagttccccgggtccctttaaccccgcgggtccccgtacccgtacggaccttaaccggagggtaaccgtacccgaacccggtaccggaggtaccgtaccggtaaccgtacgggtcccggtccgggttggtcccgttaacggtcccggttaacggtaccgtaaacggtacccgttaccgttaccccgtaggtaccgttggtacccggtagtacggtaacgggtttccgggcgttacgggaaccgtaacggcggttactaacggg

SEQ ID NO: 304188 - DNA, 638 bp, Homo sapiens
  misc_feature: GZ8MTXP02HYUMX.4.36.D03.1.454.CMB.2.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
tcagagcactgtagcacgaccggtgctcgatttagctgcgtcacgatctctcctgtgtagcctctggattcacctttgacacctattggatgacctggggtccgccagtctccagggaaggggctggagtggggtggccaacattcggcgagatggaattgtgacacactatatggactcgtgtggaggccgattcaccatctccagacgaccaacccagaactcactntcagctagtcattgctagaaagggtcgaagttctaggggttntgtgtgtcgngtcggcgtacgtactcgtacgagagtagtaggtagtagtagtacgtagtagtacgtacgtacgtagaccgtgtacgtacggacgtacgtccgacgttcgtcctacgtacaccgaaccacgaacctaaccactaaccgtcctacgtaccgtactaccgtacgtaccgaccgtacgaccgtacggacggtaccggacgtaccggtaacggtacgtacgttcggtagtacgttcccggttacggtacgtccggttaccgtaccgtaccggtaccgtcggacccggttccgtacgtagggtacgttcgtccgttagtacgtcgtacggttacacgttacggtacgtacggtaacggtacgg

SEQ ID NO: 304189 - DNA, 687 bp, Homo sapiens
  misc_feature: GZ8MTXP02JBSRO.4.36.D03.1.454.CMB.2.raw
  modified_base (205)..(205): a, c, t, g, unknown or other
  misc_feature (205)..(205): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
tcagagcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggaggccgattcacatctccaganaccaacccaagaactcactcttcaggctatcaatgctagaaagngtcgaagtctacgggttntgtntctcgtggtcggtcgtacggtacttaccgaccgacgtacgtggtacggtaggtacgtaaggtactacgtactagtactaagttacgtactacgtcggtacggtacggtacgtacctacgtccgtacctaccgtaccaccgtaacaaccgaaccctaaccgtaaacccgtaaccgtaccctacgttaccgtcctacccgtacgtaccgtacgtactacgaccgaacggaccggtacgaccggtacggtaggtaacgtacgttacgtacggtccggttacgtacgggttacggttccggttaaccggtccggtaaccggttaaccggttaccggtaccgttacccggtaacggttaccggtcggtacgtcggtacgtcggtcgtacgtacggtacggtacggaccggtaaacgtacgg

SEQ ID NO: 304190 - DNA, 559 bp, Homo sapiens
  misc_feature: GZ8MTXP02GN6R6.4.36.D03.1.454.CMB.2.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
tcagagcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggaggccattcaccatctccaganacaacccaagactcactcttcngcaaatgaacngcctgagagccgaggacacggctatgtatttcngtgctcgggatttccgccccggancgtgcggtggcagggtatgatgctatttgatagtcgtggggaccaaggacagtgtcaccgtctctcgacgccctaccaccgaacggcccacgtccgtcccttcccccgtcggcccgtcccgtcgcccgtccgacggaccgccgaccgtcccgacgacgcgacgacggccggcccgtcgggccgtcgccgtggtaccgaacggtacctaccttccctacgtcgtcgccgtcgtcgaacggccggcgtcggacgaacggtcgacgag

SEQ ID NO: 304191 - DNA, 510 bp, Homo sapiens
  misc_feature: GZ8MTXP01EAEBN.10.43.D10.1.454.CMB.2.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgctccaggggaangccacctctcctgcagggccagtcagagtgttggcgctagtagcctggtaccaanagaaacctggccaggctcccaggcccctnatctatggtncatccaaacngggccatggcatcccagccaggttcagtggccaggtgggtctggggacaagacttcactctcacatcatcagctgganctgaagatgttnctagttatactgtcaacatcgtacgagtggcctcggggcacgttcgcccgtggaccaagtggattagtacaaacgtaactgttggcttcgctaccaatctgttcttcgaacgttccc

SEQ ID NO: 304192 - DNA, 596 bp, Homo sapiens
  misc_feature: GZ8MTXP01EEU8A.10.43.D10.1.454.CMB.2.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagcatagtagtgcacgaccggtgctcgatttagactagcagtaaggggaggaactgctcagttaggacccagagggaaccatggaagcccagctcagcttctcttcctcctgctactctggctcccagtttcagataccaccggagagattgtgttgacacagtctccagccaccctgtctttgtctccaggggaaangccacctctcctgcagggccagtcagagtgttggcgcctagtagcctggtaccaanagaaacctggccaggctcccaggcccctanatctagtggtncactaccaacgcgggcccagtcggacactcccgagcctaggttcaggtggccagggtgggtctggggacaagtaccttcactcaccaccatcatcacgcgtggacgctagaagtagttgttagacttagtttacttacgtacgtacaacgtacgttacgtaaccgtaggtccggtcccggtcccggggtacctaccgtttccggtcccgtacgggaaccgtaaaggtggtaacttaacgtaacgaaacgtaacgtggttggcgttcgaacctactaactcgtcgttcttcttcgttccg

SEQ ID NO: 304193 - DNA, 518 bp, Homo sapiens
  misc_feature: GZ8MTXP01AON4I.10.43.D10.1.454.CMB.2.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (421)..(421): a, c, t, g, unknown or other
  misc_feature (421)..(421): n is a, c, g, or t
  modified_base (514)..(514): a, c, t, g, unknown or other
  misc_feature (514)..(514): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctagtagcctggtaccaacagaaacctggccaggctcccaggccccctnatctatggtgcatccaacagggccactggcatcccagccaggttcagtgccagtgggtctggggacaagacttcactctcaccatcatcagcctagagcctgaagatgttgctagtttattactgttcaacgntcgtaccgagtggcccgtccggggcctacgttcggccctgggaccaagtcggattagtcaaacgaactgttggcttgcaccaatctgttctcnttcc

SEQ ID NO: 304194 - DNA, 621 bp, Homo sapiens
  misc_feature: GZ8MTXP01DO3F8.10.43.D10.1.454.CMB.2.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (395)..(395): a, c, t, g, unknown or other
  misc_feature (395)..(395): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagatttgtgttgacacagtctccagccaccctgtctttgctccaggggaangccacctctcctgcagggccagtcagagtgttggcgcctagtagcctggtaaccaanagaaacctggccaggcctcccaggcccctnatctatggtncatccaacgcgggccactggcactcccagccaggttcaggtcggccaggttgggtctaggggacaagacttcactctacaccatcatcagcctgganccgtagaagtagttgttagtacttagtttattacgttagttactaacgtacgttacggttaacccgaggtcggtccccggtccggggggtcccttaaccgtttcccgggtcccggttacggggaaccgtaaaggtaacgggtaacgttacgtaaaccgaaacgtaaacgtggttacggcttacggaacctaccgtaacttcgtcgttccttcttaacgtttccccg

SEQ ID NO: 304195 - DNA, 599 bp, Homo sapiens
  misc_feature: GZ8MTXP01AX3Z7.10.43.D10.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgttggcgcctagtagcctggtaccaacagaaacctggccaggctcccaggcccctnatctatggtncatccaacgnggggcccagtggcatccccgagccaggttcaggtcgccaggtggtctgggacaagcttcactctcacatcatcagcnggnctgagtatgtanctagtttatactgtacaacgtgttaccggtaacgaggttcggcccggttccccgggggtaccttaccggttttcccgggccccggttaggggaccccgtaaaggtcgggtaacttacggtaaccaaaacggtaacgttcgggttcgggcttacggtcccaaaccgtcttccgtcgttacctttccaaccttttccccg

SEQ ID NO: 304196 - DNA, 534 bp, Homo sapiens
  misc_feature: GZ8MTXP01DH2DJ.10.43.D10.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
  modified_base (514)..(514): a, c, t, g, unknown or other
  misc_feature (514)..(514): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaagngccacctctcctgcagggccagtcagagtgttggcgcctacgtagcctggtaaccaacagaaacctggccaggctcccaggcccctnatctatggtncatccaagagggccactggcatcccagccaggttcagtggccaggtgggtctgggacagacttcactctcaccatcatcacgccgtggagcctagaagatgttnctagtttatactgtacaaatactcgtacgagtcggcccgtccgggggctaccgttcggcccgtaggaccaaggtgattagtacaaacgtaacgtgttaggcttgccactntctgttctcttaacttcccg

SEQ ID NO: 304197 - DNA, 518 bp, Homo sapiens
  misc_feature: GZ8MTXP01AC7YE.10.43.D10.1.454.CMB.2.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (511)..(511): a, c, t, g, unknown or other
  misc_feature (511)..(511): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagagtgttggcgcctagtagcctggtaccaacagaacctggccaggctcccaggcccctnatctatggtgcatcccaaagagggccaatggcatcccagccaggttcagtgccagtggtctgggacagacttcactctcaccatcatcagctggagctgaagatgttgctagttatactgtacaacgtatcgtaccgagtcggccgtccgggggcctacgttccggccctgggaccaaaggtcggattagtacaaacgactgttgcttgcaccaatctgttctcncttcccg

SEQ ID NO: 304198 - DNA, 591 bp, Homo sapiens
  misc_feature: GZ8MTXP01BV2HO.10.43.D10.1.454.CMB.2.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccacctctcctgcagggccagtcagagtgttgcgcctagtagcctggtaccaanacgaaacctggccaggcctcccgaggccccctnatcatggtncatccaagcgggccagtcggcactcccagccaggttcaggtgccaggtggtctgggacaagacttcactcncaccatcatcagtccnggacgcctagaagtagtgttgtacttagtttattacgtagttacaacgtatccggtaacgacgttcggcccgtccgggggcctaccgggtttcccggacccggttacgggaacccgtaaaggtcgggtaacttacgtaaaccgaaacgtaaacgttcgttacggcgttgaaccacctaattctgttaccttcaacgttccccg

SEQ ID NO: 304199 - DNA, 537 bp, Homo sapiens
  misc_feature: GZ8MTXP01C2Z7E.10.43.D10.1.454.CMB.2.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctntcctgcagggccagtcagagtgtgcnctagtgcctggaccaanagaacctggcaggcctcccaggcccctnatctatggtncatccaaagngggcccatggcatcccagccaggttcagtgcaggtggtcngggacaagcttcactctacaccatcatcagcctggacncctagaagattgttgactagtttatactgtacaactacgtacgtaccgagtcggcccgtccgggggcctacgttccgccgtagggaccaaaggtggattagtacgaaacgtaacgtgttacggcttcgaacactaattctagttccttcgaacttcccg

SEQ ID NO: 304200 - DNA, 557 bp, Homo sapiens
  misc_feature: GZ8MTXP01D391Y.10.43.D10.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccacctctcctgcagggccagtcagagtgttggcgcctagtagcctggtaccaacagaaacctggccaggcctcccaggcccctnatctatggtncatccaagacggggcccacgtggacactccccagcctaggttcagtcggccaggtgggtctggggacaagcttcactctcacntcatcagctgganctgaagatgtgctagttactatgtacaacgtntcggtaccgagtcggcccgtcgggggcctacgttccggcccgttagggacccaaggtcgtattactacgaaacgtacgtaggttcggcttcggaaccctactaacgttctcgttaccttcgcgtttccccg

SEQ ID NO: 304201 - DNA, 607 bp, Homo sapiens
  misc_feature: GZ8MTXP01BWOPH.10.43.D10.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcncctacgtagcctggtaccaacagaaacctggccaggcctcccaggccccctnatctatggtncatccaacagggcccactggcatcccagccaggttcagtggccagtgggtctgggacaagacttcactctcaccatcatcagcctggagcctgaagtagtgttgctagtttattactgtacctaagacttcggtaacgagttcggcccgtccgggggtcctaccggtttcccggccccggttacgggaacccgtaaagggtcgggtaacgttaacgttaccgaaaaccgggtaaaccttggttacggggcttacgggtaaccgacccctaagttaccgtgttacctttaaccttaacgtttccccg

SEQ ID NO: 304202 - DNA, 641 bp, Homo sapiens
  misc_feature: GZ8MTXP01BT0S9.10.43.D10.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccaccctctcctgcagggccagtcagagtgttggcgcctacgtgcctggaccaacagaacctggccaggcctcccgaggccccctnatctagtggtgcatccaacgngggccacgtggcactcccagccaggttcaggtgccaggtgggtctgggacagacttcactcncacatcatcagcgtggacgcctagaagtatgttgtcgttaagtttattacgttagtaccaacgtacgttaccggtaaccgtacggttccgggccccggttacccggggggtcccttaacccgggttttcccgggtccccggttacggggaaaccccgtaaagggtcggtaacgttaacgtaaccgaaacggtaaaccgttgggttcgggttccttacggaaccctaccgtaacgttccttcgttccctttcgttaaccttttccccg

SEQ ID NO: 304203 - DNA, 563 bp, Homo sapiens
  misc_feature: GZ8MTXP01CKN1S.10.43.D10.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (387)..(387): a, c, t, g, unknown or other
  misc_feature (387)..(387): n is a, c, g, or t
tcagcatagtagtgcacgaccggtgctcgatttagactagcagtaagggggaggaactgctcagttaggacccagagggaaccatggaagccccagctcagcttctcttcctcctgctactctggctccagtttcagataccacggagagattgtgttgacacagtctccagccacctgtctttgctccgaggggaaangccacctntccngcagggccagtcagagtgtgcnctagnctgacanagaacngcagcncngcctnatcangtncancanggcangcatccagcaggtcagtgcaggtggtctgggacagacttcactctacaccatcatcagctggacgctagaagtatgttgactagtttattactgtacaaacgtntacggtaccgaggtcggtcccggtccgggggtcctaaccggtttccggacccgttacgggaacccgtaaaggtaagggaacttaaagaaccgttaaaacggtaaacgttgggttaacgggttcttaggaaccctaaccgtaagttcgttcgttaccttaacgttaacgtttccccg

SEQ ID NO: 304204 - DNA, 577 bp, Homo sapiens
  misc_feature: GZ8MTXP01DI1AU.10.43.D10.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaangccacctntcctgcagggccagtcagagtgttggcncctagtncctggtaaccaanagaacctggccaggctcccaggcccctnatctatggtncatcccaanggggccaagtggcactcccagccaggttcaggtggccaggtggtctgggacaagacttcacttcncacntcatcagctggacgcctagaagtattgttacgactagtttatactagtacaagtacgtcgtacgtaggtcggtcccgtccgggggcctaccgtttccgggcccgttacggggaacctaaagggtcggtaattacgttaccgaaacggtaactgggttacggcgttacgaaccgaacctgttcctgttccttcgttcgtttccccg

SEQ ID NO: 304205 - DNA, 590 bp, Homo sapiens
  misc_feature: GZ8MTXP01A9IKR.10.43.D10.1.454.CMB.2.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagagtgtggcgctagtagcctggtaccaanagaaacctggccaggcctccaggcccctnatctagtggtgcatccaagngggccacgtggcactcccgagcctaggttcagtcggccaggtggtctggggacaaggaccttcactctcacatcatcagcctggacgctagaacgtagttgttgcttagtttactactgtacaacgtattccggtaaccgaggtcggcccgtccgggggtacctaccggtttccggcccgttacgggaaccctaaaggtcggaacttacgtaacgaaaccggtaacttgggttacggccttcggaaccctacctaagttccgtgttaccttcttaacgtttccccg

SEQ ID NO: 304206 - DNA, 632 bp, Homo sapiens
  misc_feature: GZ8MTXP01C4M0X.10.43.D10.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagagtgttggcgcctacgtagcctggtaccaacagaaacctggccaggcctcccaggcccctnatctatggtgcatccaacngggcccatggcatcccagccaggttcaggtggacgtggtcgtggaganaacgtctcnctccaccactcactcacgacgtcgtacggactcgtaaggtaatgtttcgtacgtacgtttatttaacttcggttactaaccgtaacgttaccggttaccggtaacggttcgggtcccggtaccccgggggtcccggtaccttttcccgggtcccggtaccgggtaaccggaaacgtagggtaacgtaattaccgtaaacgaaacgttacggtggccgttcgaccgtaaccgtaactcgttcgtctttcctaaccttcgtttcccccg

SEQ ID NO: 304207 - DNA, 525 bp, Homo sapiens
  misc_feature: GZ8MTXP01EV6M0.10.43.D10.1.454.CMB.2.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagagtgttggcgcctagtagcctggtaccaanagaaacctggccaggcctcccaggcccctnatctatggtgcatccaangggccatggcatcccagccaggttcagtgccaggtgggctgggacaagacttcactctcaccatcatcancctggancctgagatgttgctagtttatactgtacaacgtattcggtaccgaggtcggcccgtccgggggcctacgtttccggcctagggaccaaagtggtattatacgaaacgtactgagcttgcacaatctgttcttcttaacttccc

SEQ ID NO: 304208 - DNA, 667 bp, Homo sapiens
  misc_feature: GZ8MTXP01CLL2Q.10.43.D10.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (441)..(441): a, c, t, g, unknown or other
  misc_feature (441)..(441): n is a, c, g, or t
tcagcatagtagtgcacgaccggtgctcgatttagactagcagtaagggggaggaactgctcagttaggacccagagggaaccatggaagccccagctcagcttctcttcctcctgctactctggctccagtttcagataccaccggagagattgtgttgacacagtctccagcccacctgtctttgtctccaggggaangccacctntcctgcagggccagtcagagtgtgcgctagtagcctaggaccaacgagaaacctggaccaggctcccgacggcccctnatctatggtgccactcccaaacgcggggacccagtcggaccacgtcccccaaggccctaagggtttccaggttcggaccctaggggttggggtctcggggaactaacggtacttccaactctaccaccctatcaatccgagtccctagggaaccncgtagaagtagttcgttacgtacgttagtttacttacgtacgtaccaaacggttacgttaccggtaccgtacgggtccggtccccggttcccggggtaccttaccggttccggtacccgtacgggtaacctaaagggtcgtaacttaacgtaacgaaacggtaaacgtcggttacgcgttacgtaacctaccgtcgttcgttcgttaccttcgttaaccgttcccg

SEQ ID NO: 304209 - DNA, 530 bp, Homo sapiens
  misc_feature: GZ8MTXP01BAT7G.10.43.D10.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccacctctcctgcagggccagtcagagtgttggcgcctacgtagactggtaaccaacagaaacctggccaggctcccaggcccctnatctatggtgcatcccaagngggccactggcactccccagccaggttcagtggccaggtggtctgggacagacttcactctcacntcatcagcctggancgtgaagtagtgttncgtagtttattactgtacaactagtcgtacgaggtcggccgtccggggcctacgttccggcctgggaccaagtggattatacgaaacgatgngcttcgaacncgaatctcgttactcttaactccg

SEQ ID NO: 304210 - DNA, 556 bp, Homo sapiens
  misc_feature: GZ8MTXP01DLJZC.10.43.D10.1.454.CMB.2.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagagtgttgcgcctagtgcctgaccaanagaactgcaggctccagccctnatctanggtncatccaacgngggccatggcactcccagccaggttcagtcggccaggtggtctgggacaagcttcactcacacatcatcanctganctgaanatgtnctagttatatgtacaatatcgtacgtagtcggcccgtccgggggtacctacgtttccggacccgttacgggaaacctaaaggttaagggaattaacttacgaaaacggtaaacgtggttacgttcgttcggaaccaacctaagttcttcggttaccttcgttaacgtttccccg

SEQ ID NO: 304211 - DNA, 643 bp, Homo sapiens
  misc_feature: GZ8MTXP01B4UP9.10.43.D10.1.454.CMB.2.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (394)..(394): a, c, t, g, unknown or other
  misc_feature (394)..(394): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangcccaccctctcctgcagggccagtcagagtgttgcgctagtagcctggaccaanagaactggccaggcctcccacggccctcactcggggtatggtgcactcccaacgacgggccacgtcggcactcccagccacgggttcaggtggccgaggtggtcgtgggacaagacttcactctcaccatcatcganccgtggacgctagaagtattgttagcttagtttattactgtaccaacgtacgttaccggtaaccgacggtccggccccggttcccgggggtacccttaccggtttcccgggaccccggttacgggaaacccgtaaagggttcggtaacgttaacgtaaaccgaaaacggtaaacgttcgggttcgggttaccttcggtaaccctaccttaacgttccgttacgtttccctttccgttaacgtttccccg

SEQ ID NO: 304212 - DNA, 635 bp, Homo sapiens
  misc_feature: GZ8MTXP01EHD5R.10.43.D10.1.454.CMB.2.raw
  modified_base (202)..(202): a, c, t, g, unknown or other
  misc_feature (202)..(202): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (450)..(450): a, c, t, g, unknown or other
  misc_feature (450)..(450): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccacctctcctgcagggccagtcagagtgtgcgctagagcctggaccaanagaacctggccagctccacggccctnatctatggtncatccaagcggccatcggcactcccgagcctaggttccaggtcggccgtaggtcgggtctggggacaagtaccttcgactctacacctatcgatcagcctaggacgctagaacgtatgttgacttagtttatacgtcgtacaaacgtacgttcgtaaccgnggttaccgggcccggttaccgggggcccttaaccggtttcccgggacccggtacgggaaaccgtaaagggtaacgggtaacgttaactaccgttaaaacggtaaccgtagggttacgggcctttacggaacctaaccgttaacgtttccttacggtttccctttaaccgttaaccgttttccccg

SEQ ID NO: 304213 - DNA, 584 bp, Homo sapiens
  misc_feature: GZ8MTXP01BGUL2.10.43.D10.1.454.CMB.2.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
  modified_base (440)..(440): a, c, t, g, unknown or other
  misc_feature (440)..(440): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccaccctctcctgcagggccagtcagagtgttggcgtcctacgtagcctaggtaccaacgacgaaacctggccaggctcccgaggcccctnatctagtggtgcactcccaacgcggggcccacgtggccactccccagccgaggtttcagtggccaggtgggtcngggacaagacttcactctcacatcatcagctggacnctgagagtgttgctagtttactactagtacaacgtnttcggtaccgaggtccggcccgttccgggggtcctacggtttccggcccgttaggggaccgtaaaggtggtaagttactaaccgaaacggtactggttcggcttacggcctacaacgttctcgttccttcgttaactttccccg

SEQ ID NO: 304214 - DNA, 627 bp, Homo sapiens
  misc_feature: GZ8MTXP01ACGNM.10.43.D10.1.454.CMB.2.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (414)..(414): a, c, t, g, unknown or other
  misc_feature (414)..(414): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcctaccctgtctttgtctccgaaggggaaancgcccaccctctcctgcagggccagtcagagtgttggccgtcctacgtagcctggtaccaanagaaaccgtggccaggcctacccgacggccccctnactctatggtcnctactccaagcgggtccactggccatccccagcctaggttcagtcgccaggtgggtctagggacagtcttcactctcactatcactcacgtcgtaggacnccgtagtaagtgtgttacgacttaagtttacttacgtcgttaacaaactacgtaccggttaccgaggtccggtcccggtccgggggtccttaaccggtttcccggccgttaacgggaacgtaaacggtggtaacttaaacgtaccgaaaccggtacgtgggttacgccgttaacgccctaactcttcgttcgttcttccgttaacgttccccg

SEQ ID NO: 304215 - DNA, 659 bp, Homo sapiens
  misc_feature: GZ8MTXP01AO3BK.10.43.D10.1.454.CMB.2.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagagtgttggcgctacgtagcctggtaccaacagaaacctggaccaggcctcccgacggccccctnatctatggtgcatcccgaacgacggggtccacgtggccactccccgacgtccaaggttcagtcggacccaggtggggtctggggacaaggtaccttcactctacacatcactcagccgtggagccgtagaagtatgttgcgttagtttattacgtgttacaacgtagtacggtaccgacggtcggtcccggtccgggggacccttaccggtttcccgggacccgttacggggaaccctaaagggtaacgggtaacttacgtaaaccgttaaacggtaaacgttcggttacgggttccttcgggtaacccaccccggttaagttcccttcggtttacccttttaaccgttaaccgtttcccccg

SEQ ID NO: 304216 - DNA, 551 bp, Homo sapiens
  misc_feature: GZ8MTXP01DZLN1.10.43.D10.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (532)..(532): a, c, t, g, unknown or other
  misc_feature (532)..(532): n is a, c, g, or t
  modified_base (544)..(544): a, c, t, g, unknown or other
  misc_feature (544)..(544): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangcccaccctctcctgcagggccagtcagagtgttggcgcctagtgcctggtaccaagagaaacctggccaggcctcccaggcccctnatctatggtncactccaacgacggggcccacgtggcactccccagccaggttcagtggccagggtgggtctggggacaaggtacctttcgacttctaccacctatcatcacgtctggacgcctagaagtattgttgcttagtttatactgtacaacgtatcggtaccgaggtcggccgtccggggcctacgttcggccgtaggaccaagtggattacgtacaaacgactgttgcttagcactntcgtgttcttcncttcccg

SEQ ID NO: 304217 - DNA, 757 bp, Homo sapiens
  misc_feature: GZ8MTXP01DJM5N.10.43.D10.1.454.CMB.2.raw
  modified_base (202)..(202): a, c, t, g, unknown or other
  misc_feature (202)..(202): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccacctctcctgcagggccagtcagagtgttggcgcctacgtagcctaggtaccaacagaaacctggacccagggcctcccgacggccccctacgacttccgtaagtgggtcgaccaactaccccgaaacgacgggggcccctaacgtcgggacctaacgttccccgaacggtcccgtaagggtttccaagggttcgggacctaggggttcggggtcgtacgggggaacctaacggtacctttccacttcctaccaaccctatcatccgacgtccgtaggacgtccgtaggaaacgtagttggttacgtacgttagtttaacttacgttacgttaaccaaacgttacgttaaccgggttaaccggtacgggttccgggtccccggttcccgggggtacccttaacccggttttcccgggacccggttacggggaaaccctaaaagggttcggtaaacgttacgtaaaccgaaacggtaaacgttcggttacggttccgttaccggaacctacccttaagtccgttaggtttacccttaacgttaacctttcccg

SEQ ID NO: 304218 - DNA, 566 bp, Homo sapiens
  misc_feature: GZ8MTXP01EFKBU.10.43.D10.1.454.CMB.2.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
tcagcatagtagtgcacgaccggtgctcgatttagactagcagtaaggggggaggaactgctcagttaggacccagagggaaccatggaagccccagctcagcttctcttcctcctgctactctggctcccagtttcagataccacggagagattgtgttgacacagtctccagccaccctgtctttgctccgaaggggaaancgccaccctctcctgcagggccagtcagagtgttggcncctagtagcctaggtaaccaacagaaactggccaggctccaggccctnatctatgncanccaanagggccagtgcactccagccaggtcagtgccaggtggntgganaagacttcactctcacatcagtcagctaggagcaggaanatggtntatagttatatagtacaacgtagtacgtacgacgtcggcccggtcgggccttacggttccgaccgtacggaaaccgtaaaggtaaggtaacttaagtaaaccgaaacgtaacgtacggttcggttcgacgtaactaacctaacgttacgttcgttacttccgttaacgttccg

SEQ ID NO: 304219 - DNA, 717 bp, Homo sapiens
  misc_feature: GZ8MTXP01EGQTB.10.43.D10.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcagggccagtcagagtgttggcgcctacgtagcctggtaccaacagaaacctggccaggcctcccgacggccccctnatctagtggtcgaccatcccgaaacgacggggcccaacgtcgggccaccttccccaaggccccgtaaggggtttccaaggggtcgggacccgtaagggttcgggggtactagggggaaccctaacgggtaaccctttcgacttccctacccaactactcaatccgtacgcccgttaggacggcctaggaaagtagttaggttcgacgttagtttacttacgtgtactaacggtacgttccggtaaccggtcggtccggggtccccggtacccgggggtcctaacccggttttccgggacccggttacggggaaacccgtaaaggtaacgggtaacttaacgtaaaccgaaaacggtaacgtcggttacgggttccttagaacctaaccgtaacttccgtcgttccttcgttaacgtttccccg

SEQ ID NO: 304220 - DNA, 536 bp, Homo sapiens
  misc_feature: GZ8MTXP02HRYHU.10.43.D10.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaanagaaacctggccaggctcccaggcccctnatctatggtncatccaacagggccactggcatcccagccaggttcagtgccagtggtctggggacagacttcactctcaccatcatcagcctggacnctgaagatgttnctagtttattactgtacaactattcgtaccgtagtccggccgtcccgggggcctacgtttcggccgtacgggacctaaaaggtggatatacaaaacgtactcgtgctgaacgtacacttctgtcttactactttcccg

SEQ ID NO: 304221 - DNA, 522 bp, Homo sapiens
  misc_feature: GZ8MTXP02IYRTQ.10.43.D10.1.454.CMB.2.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctntcctgcagggccagtcagagtgttggcgcctacgtagcctggtaccaacagaaacctggccaggctcccaggcccctcatctatggtgcatccaacaggggccactggcatcccagccaggttcagtggccagtgggtctgggacagacttcactctcaccatcatcagcctggagcctgaagatgttgctagttatactgtacaacatcgtaccgagtcggccgtccgggggacctacgtttccggcccgtgggaacctaaaggtcggatatacaaacgaactgtacgctgcacatctgtcttcacttcc

SEQ ID NO: 304222 - DNA, 530 bp, Homo sapiens
  misc_feature: GZ8MTXP02HQJTP.10.43.D10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
  modified_base (516)..(516): a, c, t, g, unknown or other
  misc_feature (516)..(516): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagagtgttggcncctagtagcctggtaccaanagaaacctggccaggctcccaggccccctnatctatggtgcatccaacagggccactggcatcccagccaggttcagtggccagtggtctggggacaggacttcactctcaccatcatcagcctggancctgaagatgttgctagtttattactgtacaatacttacgtacgaggtcggccgtccgggggcctacgtttcggcccgtgggaccaaggtcggatatacgaaacgtaactcgtacgctgcacgactcgtntcttctacttcccg

SEQ ID NO: 304223 - DNA, 524 bp, Homo sapiens
  misc_feature: GZ8MTXP02I0780.10.43.D10.1.454.CMB.2.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctacgtagcctggtaccaacagaaacctggccaggctcccaggcccctcatctatggtncatccaacngggccatggcatcccagccagttcagtggccagtgggtctggggacagacttcactctcaccatcatcagcctggacnctagaagatgtgctagtttatactgtcaacattcgacgtaggtcggcccgtcgggggccctacgtttccggcccgtgggaccaaaggtcggatagtacaaacgaactgtacgctagcaccgatctgtcttcactttcc

SEQ ID NO: 304224 - DNA, 507 bp, Homo sapiens
  misc_feature: GZ8MTXP02IHAGB.10.43.D10.1.454.CMB.2.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (464)..(464): a, c, t, g, unknown or other
  misc_feature (464)..(464): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctntcctgcagggccagtcagagtgttggcncctagtagcctggtaccaacagaaacctggccaggctcccaggcccctnatctatggtgcatccaacagggccactggcatcccagccaggtcagtgcagtggctgggacngacttcactctcaccatcatcancnganctgaagatgttncgtagtttatactgtcaacattcgaccgagtcgccgtccggggctacgtttcgcctcgggacaaagtcggatanacaaacgactcgtacgactgaacacatcgtatcttacacttcc

SEQ ID NO: 304225 - DNA, 719 bp, Homo sapiens
  misc_feature: GZ8MTXP02IA43I.10.43.D10.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgtggcncctagtagcctggtaccaacagaacctggcccaggccctccgaccgtcccnactctagtggnactactaccgaacggcgggaccagtcggactaccgtcccgacgccgtacggttacgaggtcggaccgtaggggttcgggtcgtaggggactacggttccttccaccttctacccaacctatccaatccgaccgtccgtaggaccgtccgtaaaggaacgtagtttggttcgtaacgtttaagttttacttaacgttacgttaacctaaacgttacgttaccggtaaccggtacgggtccggtccccggggtaccgggggtaccctttaccgggtttcccggtacccggtaccgggtaaaaccgtaaacgggtggtaaactttacgtaaaaccgtaaaacggtacgtttacgggtacgtaccgtaccggaacccgtaccttaacgtccgttcgtttacccttacgttacctttcccccg

SEQ ID NO: 304226 - DNA, 611 bp, Homo sapiens
  misc_feature: GZ8MTXP02IFT8K.10.43.D10.1.454.CMB.2.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagttttcagataccaccggagagattgtgttgacacagtctccagccaccctgtctttgtctccaggggaaagngccacctctcctgcagggccagtcagagtgtgcgcctagtagcctggtaccaanagaaacctggccaggctcccaggcccctnatctatggtncatcccaacngggcccatggcactcccagccaggttcagtggccagtgggtctggggacagacttcacttctccaccatcaatccagtcctggacgcctagaagtattggttgacttagtttacttacttagtacctaaactacgttccgtacgtaggttccggcccgtccgggggtcccttacggtttccgggcccgttacggggaaaccgtaaacggttacggaattaacgtaacgtaaaaccggtaacttcggtacggtactcggaaccgtaaccgtacgttaccttcgtttcctttacaacgtttccccg

SEQ ID NO: 304227 - DNA, 515 bp, Homo sapiens
  misc_feature: GZ8MTXP02F8D5G.10.43.D10.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctagtagcctggtaccaacagaaacctggccaggctcccaggcccctnatctatggtncatccaacagggccatggcatcccagccaggttcagtggcagtggctgggacagacttcactctcaccatcatcagcctggagctagaagatgttgctagtttatactgtacaacatcgtaccgagtggccgtccgggggctacgtttcggccgtgggaccaagtaggagtatacaaacgaacgtacgtaggctcgcgacactctgtcttcacttcc

SEQ ID NO: 304228 - DNA, 509 bp, Homo sapiens
  misc_feature: GZ8MTXP02IN9PL.10.43.D10.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (474)..(474): a, c, t, g, unknown or other
  misc_feature (474)..(474): n is a, c, g, or t
  modified_base (489)..(489): a, c, t, g, unknown or other
  misc_feature (489)..(489): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaangccacctntcctgcagggccagtcagagtgttggcgcctagtagcctggtaccaacagaacctggccaggcctcccaggccccctnatctatggtncatcccaagacgggcccagtggccactcccagccaggttcagtggccagtggtctgggacagacttnactctccaccatcatcagcctggacnctgaagtntgttgtctagtttattactgtacaacattcgtaccgagtcggccgtccggggctacgttcgcctggacagtcgatancaaaacgactgacgntgcacatctgtctcacttcc

SEQ ID NO: 304229 - DNA, 655 bp, Homo sapiens
  misc_feature: GZ8MTXP02HRZJC.10.43.D10.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (314)..(314): a, c, t, g, unknown or other
  misc_feature (314)..(314): n is a, c, g, or t
tcagcatagtagtgcacgaccggtgctcgatttagactagcagtaagggggaggaactgctcagttaggacccagagggaaccatggaagccccagctcagcttctcttcctcctgctactctggctccagtttcagataccacggagagattgtgttgacacagtctccagccacctgtctttgtctcaggggaaangccacctctcctgcagggccagtcagagtgttggcnctacgtagcctggtaccaacagaaacctggccaggccnccacgccncatctatgtgcactacaacgacggacactgcacnccacgacgacgtacgagtggcgaggtggtcgtggacgacgtactctactactaccaccactacactacacgaccgtacggacgacgtacgaagtagttagttacgtacgttaacgtttacgtttaacgttacgtaactaaactaacgttacgtaaccggtacggtaccgggtaccgggtacccggggtacccggttaccgtttacccggtacccggtaccgggtaaaccggtaaaacggtaacggtaacgtaaacgtaaacgtaaaacgtaaacgtacggtacggtacgtacgtaaccgtaaccgtacgttacgttacgttaccgtttaccttacttaccg

SEQ ID NO: 304230 - DNA, 686 bp, Homo sapiens
  misc_feature: GZ8MTXP02HA9D2.10.43.D10.1.454.CMB.2.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgatacagtctccagccaccctgtctttgtctccgaggggaaangccaccctctcctgcagggccagtcagagtgttggcncctacgtgcctggtaccaacagaaccnggccaggcctcccgaggccccctnatcctatggtgcatcccaacgacgggcccacgtggcactccccgaagccgagggtttccaggtcggcccgtaggtcggggtctaggggacaggtacctttccaccttcgtaccaaccctatccaactcacgtccgtggacgccgtagaacgtagttggttgtacgtagtttacttacgttagtacctaactacgtaccggtaccgtacgggtcgggtccccggtcccggggggtcccttaccggtttcccgggtaccccggttaccgggggtaacccgtaaaacgggttacggtaacgttaacgtaaacccggtaaaaccggtaacgttacggtacgggtaccgtacggaacctacccgtacttccgttacggttcctttaccgtactttccccg

SEQ ID NO: 304231 - DNA, 626 bp, Homo sapiens
  misc_feature: GZ8MTXP02HB51Q.10.43.D10.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctacgtagcctggtaccaacagaaacctggccaggcctcccgaggccccctnatctagtggtgcatcccaacgcgggccacgtggacactcccagccaggttcaggtcgcctaggtggtctgggacagacttcactctcaccatcatcacgctggacnccgtagaagtattgtagtacgttagtttacttactgtacctaaactacgttacgtaccggtaggtcgggtcccggtccgggggtacctaccggtttccgggacccgttacggggtaaccgtaaaacgggttcggtaaacttacgtaaccgtaaaacggtacgttacggtacggtactacggccgtaaccctagttccgttacgttaccctttaccgtacgtttccccg

SEQ ID NO: 304232 - DNA, 556 bp, Homo sapiens
  misc_feature: GZ8MTXP02JTSTT.10.43.D10.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (394)..(394): a, c, t, g, unknown or other
  misc_feature (394)..(394): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcncctagtagcctggtaccaacagaaacctggccaggctcccaggccccctnatctatggtgcatccaacngggccacgtggcatcccagccagttcagtggccagtgggtctgggacagtcttcactctcacatcatcagcctgacgctgaagtntgtgctagtttatactgtacaactagtcgtacgaggtcggccgttcccgggggcctacggtttcccggccgttacggggaacctaagggtacggaatacgacgtaaaacgacgtacgtacggcgtacgcctaaccgcgttcctgttccttctactttccccg

SEQ ID NO: 304233 - DNA, 577 bp, Homo sapiens
  misc_feature: GZ8MTXP02JTZB0.10.43.D10.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgctacgtagcctggtaccaacagaaacctggccaggctcccaggccccctnatctatggtgcatcccaacnggggccactggcatcccagcccaggttcagtggccagtgggtctggggacngacttcactctcaccatcatcagcctggagcctgaagntgttgctagtttatactgtacaacattcgtaacgagttcgggaccctcccgggggtcctaccgtttcgggccccgttaggggacccaaaaggttgggaactagtaccgaaaacgtaacgtgtacgggaccttaggaaccgaacccgttacttccgtacgttccttactaccgttcccg

SEQ ID NO: 304234 - DNA, 604 bp, Homo sapiens
  misc_feature: GZ8MTXP02ITCJ8.10.43.D10.1.454.CMB.2.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagagtgttggcgcctagtgcctggtaccaanagaacctggccaggctcccaggcccctnatctatggtncatcccaacgnggggcccactggcactcccagcccaggttccaggtggccaggtgggtctggggacagacttcactctcaccatcatcagctggacgctgaagatgttgctagtttatacttgtactaactacttcgtaccgtagggtcggcccgttaccgggggccctacggtttccgggcccgttaggggaacccgtaaaagggtcggaacgttaactacgaaaaaccggtaacgttcggtacggtcgttacgaaccgtaaccgtactttccgtcgtttacctttccttaaccgtttttcccccg

SEQ ID NO: 304235 - DNA, 587 bp, Homo sapiens
  misc_feature: GZ8MTXP02FWNLW.10.43.D10.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagagtgttggcgcctacgtagcctggtaccaacagaaacctggccaggctcccaggcccctnatctatggtncatccaangggccagtggcactcccagccaggttcagtgccaggtggtctgggacagcttcactctcaccntcatcagcctggacgcctagaagtatcgttagcttagtttacttacttgtaccaaatacgttacgtaccgtaggtcggaccccggtccgggggcctacggtttccggcccgtacgggaaccgtaaaggtcggaattaactacgaaaacggtaaccgttggtacggcttacggaaccgtaacctaacgttcgttacgtacctttacgtaactttccccg

SEQ ID NO: 304236 - DNA, 673 bp, Homo sapiens
  misc_feature: GZ8MTXP02G3YVZ.10.43.D10.1.454.CMB.2.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (290)..(290): a, c, t, g, unknown or other
  misc_feature (290)..(290): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagagtgttggcncctagtagcctggtaccaacagaaacctggaccaggcctcccaggccccctnatctatggtgcactcccaaacgacggggcccaacgtgggacctacgtccccaagccccgtaagggtttccaggtggacccgtaggtcggggtctggggacaggtacttccgacttctaccaacctatcatccaagtccctagggacgcctagaagtagttgtacgtacttaagtttacttacgttagtacctaaactacgttaccggtaccggtagggttaccgggcccggttacccgggggacccttacggtttcccgggaccccggttaacggggaaacccgtaaaaggggttaccggtaagttaaaccgtaaacggaaaacgtacgtcggtacggtctacgaaccgtactacgttcgtacgttcctactacgtttccccg

SEQ ID NO: 304237 - DNA, 554 bp, Homo sapiens
  misc_feature: GZ8MTXP02JQR8J.10.43.D10.1.454.CMB.2.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctnatctatggtncatccaacaggccactggcatcccagccagtcagtgccagtggctggggacagacttcactctcaccatcatcagcctggacgcctagaagatggttgcgtagtttattacgttagtactaacacttacgtaccgtaggtcggtcccgtccgggggccctacggtttccggccccgttacggggacccaaaaggtcggattactaccgaaaacgaacctgtacggctaggccacactctgtctttcactttcccg

SEQ ID NO: 304238 - DNA, 595 bp, Homo sapiens
  misc_feature: GZ8MTXP02JNXZF.10.43.D10.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccaccctntcctgcagggccagtcagngtgtggcnctagtnctgaccanagaacnggccaggcnccagcccnatctatggtcncntccaagnggccagtcggcactcccagccaggttcaggtcggaccgtaggtggggtctaggggacagtacttcgactctcaacctntcatcagtcctggacncgtagaacgtattgtgtacgtaagtttactacgtgtacaactactccgtacgtacggtcggtacccgtccggggtacctacggttccggtacccgtacgggtaacccgtaaaggtacggtaacgtacgtaacgtaaaacggtaccgttaggtacgggtactcggaacctaccgtacgttccgtacgttccttacgtactttccccg

SEQ ID NO: 304239 - DNA, 543 bp, Homo sapiens
  misc_feature: GZ8MTXP02JFZ7K.10.43.D10.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagttttcagataccaccggagagattgtgttgacacagtctccagccaccctgtctttgtctccaggggaaangccacctctcctgcagggccagtcagagtgttggcgcctacgtagcctggtaccaacagaaacctggccaggctcccaggccccctnatctatggtgcatccaacgngggcccactggcactccccagcccgaggttcaggtggcctaggtgggtctggggacaggctcgactctcaccntcatcagctgagctagagatgtgctagttactactgtactaacattcgtacgaggtcggccgtccggggacctacgtttccggcccgttacgggacctaaggtcgactactaacaaacgtaactcggtacggctagcaccgtatctgtcttcacgttccc

SEQ ID NO: 304240 - DNA, 679 bp, Homo sapiens
  misc_feature: GZ8MTXP02JE4X6.10.43.D10.1.454.CMB.2.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
tcagcatagtagtgcacgaccggtgctcgatttagactagcagtaaggggaggaactgctcagttaggacccagagggaaccatggaagccccagctcagcttctcttcctcctgctactctggctccagtttcagataccaccggagagattgtgttgacacagtctccagccaccctgtctttgtctccagggaaangccacctctcctgcagggccagtcagagtgttggcgcctacgtagcctggtaccaacagaaacctggccaggctccaggcccctnatctatggtncatccaacgacgggcctacgtcggacctacgtcccgacgtcccgtaagggttccgaacggtcggacccgtagggttcggggtacgtacggggaactacggtaccttcgaccttctacctacctatacactccgacgtccgtacggacgtccgtaggaaagtacgttggttacgtacgttaagtttacttaacgttacgtaacctaaactacgttaccgtaaccggtacgggttccggtacccggtccggggtacccttaccggtttccggacccgttacgggtaaccgtaaaggtacggtaacgttaacgtaaaccgaaaacgtaacgttacggtacggtacgtacgaaccgtacctacgttcttacgttaccttctactttccg

SEQ ID NO: 304241 - DNA, 564 bp, Homo sapiens
  misc_feature: GZ8MTXP02JXUX3.10.43.D10.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (382)..(382): a, c, t, g, unknown or other
  misc_feature (382)..(382): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctagtagcctggtaccaacagaaacctggccaggcctcccaggccccctnatctatggtgcatcccaacgagggcccacgtggcactcccagccaggttcaggtggccaggtgggtctaggggacagacttcactctcaccntcatcacgcctggacgcctgaagatgttgctagtttattactgtacaacagttcgtaccgtaggtcggccgtcccggggctacgttcggcccgtagggacctaaggtcggaactataacgaaacgtaacgtcggtcggactcgaaccaaccctagtccttcgttaccttcgtactttccccg

SEQ ID NO: 304242 - DNA, 563 bp, Homo sapiens
  misc_feature: GZ8MTXP02JUCTT.10.43.D10.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctacgtagcctggtaccaacagaaacctggccaggcctcccaggcccctnatctatggtncatccaacgngggccacgtggccactcccagccaggttcaggtggccagtgggtcngggacagtacttcactctcaccatcatcagcctgcnctgaantgtgctagtttactactagtacaactagtacgtaacgaggtacggcccgttccgggggacctacggtttccgggcccgttaggggaaccctaaaggtcggtaactacgtaccgaaaacgacgtcggtacggtactacgcacctacgtctgtccttcactttcccg

SEQ ID NO: 304243 - DNA, 667 bp, Homo sapiens
  misc_feature: GZ8MTXP02IGB6V.10.43.D10.1.454.CMB.2.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaancgccacctctcctgcagggccagtcagagtgtggcgtcctagtagcctaggtaccaacagaacctggccaggcctcccgacggccccctnatcctagtcggtnactactaccaacgacggggcccacgtcggcctaaccgtcccgacgtcccgtaaggtttccgaggttcggaccctagggttcggggtctacggggacacggtaccttcgaaccttctaccaaccattacattaccgaagtccgtaggggactacgtaggtaaagtagttgttacggcttaaggtttactacgttaggtaccaaacgtcgttaccggacgtaggtccgaccccggtcgggggtaccttcggtttccggaccgttacgggacctaaaggtacggtataaacgtacgaaaaccggtgttacgacggttccacggtaaccacgtacgttcgttacgtttccttactacgtttcccccg

SEQ ID NO: 304244 - DNA, 516 bp, Homo sapiens
  misc_feature: GZ8MTXP02IUTZU.10.43.D10.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (505)..(505): a, c, t, g, unknown or other
  misc_feature (505)..(505): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccacctctcctgcagggccagtcagagtgttggcgcctacgtagcctggtaccaacagaaacctggccaggcctcccaggcccctnatctatggtncatccaagcgggccacgtggcactcccagccaggttcagtgccaggtggtctgggacagtactcactcncaccntcatcagctgncngagtatgtnctagttatactgtacaactactcgtacgtggtacggcccgtccggggcctacgttccggccgtagggacctaaggtcggactatacaaacgactgcgctgcacactctntctcacttccg

SEQ ID NO: 304245 - DNA, 616 bp, Homo sapiens
  misc_feature: GZ8MTXP02HOOSB.10.43.D10.1.454.CMB.2.raw
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaagacgccaccctctcctgcagggccagtcagagtgttggcgcctagtagcctggtaaccaanagaaacctggccaggcctcccaggcccctnatctagtggtncatccaacgagggcccacgtggcaactccccagccctaaggttcaggtggcctagggtgggtcgtggggactaggtaccttcgaccttctccaccctatccaatcgacgccgtggacgcctagaagtagttgtgtacttagtttacttactagtacaactacgttacggaccgtagggtcggtacccgtccgggggccttacggttccggacccgtacggggaacctaaaggtcggtaattacgtaaacgaaaaccggtacgttcggacgtactacgtccaaccgtactcgttacgtcctttctacgtttcccg

SEQ ID NO: 304246 - DNA, 531 bp, Homo sapiens
  misc_feature: GZ8MTXP02HRF3Q.10.43.D10.1.454.CMB.2.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgtgcgctacgtagcctggtaaccaacagaaacctggccaggctcccaggcccctnatctatggtgcatccaacagggccactggcatcccagccagttcagtgccagtgggtctgggacngacttcactcncaccatcaatcagcctggagcctagaagtatgtttgctagtttattactgtacaaacatcgtaccgaggtcggaccgtcccgggggtcctacgtttcggcccgtagggaaccaaaaggtcggaatatacaaaacgactagtcgctgcgacactctgtcttcacttccc

SEQ ID NO: 304247 - DNA, 592 bp, Homo sapiens
  misc_feature: GZ8MTXP02IT2H1.10.43.D10.1.454.CMB.2.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagagtgttggcgcctacgtagcctggtaccaacagaaacctggccaggcctcccaggcccctnatctatggtncatccaanagggccatggcactcccagccagttcagtgcagtggtctgggacagacttcactcncaccntcatcagcctggacgcctgaagtatgttgacttaagtttacttacgttagtacctaaactacgttaccgtacccgtaggtccggccccggttcccgggggacccttacggtttacccgggccccgttacggggaaccctaaaagggttcggaacttaactacgaaaacgtacgtggtacggcttacggaacctaaccgtattcgtcgttccttactactttcccg

SEQ ID NO: 304248 - DNA, 528 bp, Homo sapiens
  misc_feature: GZ8MTXP02GJ793.10.43.D10.1.454.CMB.2.raw
  modified_base (202)..(202): a, c, t, g, unknown or other
  misc_feature (202)..(202): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagagtgttggcgcctacgtagcctggtaccaacagaaacctggccaggctcccaggggcccctcatctatggtgcatccaacagggcccactggcatcccagccaggttcagtggccagtgggtctggggacaggacttcgactctcaccatcatcagccctggacgcctgaagatgttgctagttattactgtacaaacatacgtaccgaggtcgccgtccgggggccacgtttcggcccgtgggaccgaaagtcggatatacgaaacgactagtcgctgcgacactctcgtctcacttcc

SEQ ID NO: 304249 - DNA, 695 bp, Homo sapiens
  misc_feature: GZ8MTXP02JBGFD.10.43.D10.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccacctgtctttgtcctccgaggggaaangccacctctcctgcagggccagtcagngtgttggcgcctagtgcctggtaccaanagaacctggccaggcctcccgacggccccctnatctagtggtnctatctaacgcggcctacgtggcactcccagcccgtaaggttccaggtcggaccgtaggtcggggtctacggggactacgtaccttcgactctaccgacctatcgactccgagtccgtagggacgtccgtaggaaaggttnttcggttacgtacgtttaagttttacttacgttacgtaacctaaacgtccgttaccggtaccgggtaccgggttacccggggtcccccgggttcccgggggtaccctttacccgggtttcccggggacccggttaacggggtaaacctaaacggggtacggtaactaaccggtaaaccgaaacggttaccggtacggtaccgtacgtcgaacccgtacgttactccggttcttaccgttaccgtaccttcccg

SEQ ID NO: 304250 - DNA, 531 bp, Homo sapiens
  misc_feature: GZ8MTXP02HH9F5.10.43.D10.1.454.CMB.2.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccacggagagattgtgttgacacagtctccagccaccctgttctttgtctccgaaggggaaancgccaccctctcctgcagggccagtcagagtgttggcncctagtagcctggaccaanagaacctgcaggcnccagcccnatcatggtncatccaagcggccagtggcactcccagccaggttcaggtcggacctaggtggggtctaggggacagtacttcactcacaccatcatcagcctgacncagaagtntgtncttagtttactatgtactaagcttacggacgaggtccgccggtaccggggccttacggttccggccgtagggaaccaggtnacttanacgaaacgacgtgacgctagcacgtntactgtctactcttcccg

SEQ ID NO: 304251 - DNA, 567 bp, Homo sapiens
  misc_feature: GZ8MTXP02FIL8T.10.43.D10.1.454.CMB.2.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaangccaccctctcctgcagggccagtcagagtgttgcgcctagtgcctggtaccaacagaacctggccaggcctcccaggcccctnatctatggncatccaaacgngggcccagtggcactcccagccctaggttcaggtgcctaggtcgggtctgggacagacttcactctcaccntcatcacgcgtggacncgtagaagtatcggttagacttagtttacttctagtaccaaatcgtcggtaccgtaggtcgggcccggtccgggggtccttacggttcccggccgtacggggaaacaaggtacggatacacgtaaacgacgtggtacggctacgaacaccgtatctacgttctcacttcccg

SEQ ID NO: 304252 - DNA, 676 bp, Homo sapiens
  misc_feature: GZ8MTXP02JVKLO.10.43.D10.1.454.CMB.2.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaangccaccctctcctgcagggccagtcagagtgttggcgcctacgtagcctggtaccaacagaacctggccaggcctcccacgcccctnatctagtgncatccaacgcgggcccacgtggaccacgtccccagtcccgaggttcacggtggccgtagggtgggtacgtaggggacacgtacttccacgttcctaccacctataccgtatccgacgcccgtaggacgccgtaggaagtagtgttcgtacgttaagtttattacgttagtactaacgtacgttaccggtaccggtacgggtcggtacccggtcccgggggtacccttccggtttccgggccccggttaacggggaacccgtaaaagggtacgggtaaacttaacgtaaaccggtaaaacgtaacggttacgggtaccgtaccgttacgaaccgtaaaccgtacgttccgttcgttacctttacctactttcccccg

SEQ ID NO: 304253 - DNA, 573 bp, Homo sapiens
  misc_feature: GZ8MTXP02HW74C.10.43.D10.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgttggcgcctagtagcctggtaccaacagaaacctggccaggctcccacggccccctnactctatggtgcatccaaacgacgggccacgtggcatcccagccaggttcaggtggcctaggtggtcgtggggactaggacttcactctcaccatcatcagcctggacgcctagaagtatgttgctagtttatactgtactaacattacgtacgtaggtcggccgtccgggggtacctaccgtttccggcccgtcgggaaccgtaaaggtcggtatacgtacaaaacgtacgtggtacggtctacgaaccacctagttctacgttcctttctactttccccg

SEQ ID NO: 304254 - DNA, 641 bp, Homo sapiens
  misc_feature: GZ8MTXP02JDOKM.10.43.D10.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagagtgttgcgcctagncctggaccacagaacngcaggctccacgcccctnatctagtggtgacactaccaacgacggggcccacgtcggcaacgtccccaggcccaggtttccaggtcggccgtagggttcggggtacgtaggggactacggtaactttccgaccttcctaccaaccacttacaacttccaacggtccgtacggacgccgtagaacgtattggttcgtacttaggtttacttacgtcgttacaaacgtactaccggttacgacggtcgggcccggttccgggggcctacggtttccggcccgttacgggaaccgaaaggttcggaacttacgtaaaccgaaacgtaacgtcggtacgccgttacgaacctaccgattccgtagtttccttactacttcccg

SEQ ID NO: 304255 - DNA, 536 bp, Homo sapiens
  misc_feature: GZ8MTXP02HFI9P.10.43.D10.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (418)..(418): a, c, t, g, unknown or other
  misc_feature (418)..(418): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagagtgttggcgcctagtagcctggtaccaanagaaacctggccaggctcccaggccccctnactctatggtgcatcccaaacagggccactggcatcccagccaggttcagtgccagtggtctgggacngacttcactctacaccatcatcanctggagcctgaagatgtgctagtttattactgtcaanatcgtaccgtagtacgccgtccgggggcctaccgttccggcccgtagggaccaaacggtggaactactacgaaaacgaactgtacggctgaacaccgactctagtcttactacttccc

SEQ ID NO: 304256 - DNA, 567 bp, Homo sapiens
  misc_feature: GZ8MTXP02GCVJA.10.43.D10.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (400)..(400): a, c, t, g, unknown or other
  misc_feature (400)..(400): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctacgtgcctggtaaccaacagaaacctggccaggcctcccgacggcccctnatctatggtgcatccaacgagggcccagtggcactcccagccaggttccaggtggccaggtcgggtcgtggggacagtacttcactctacacatcatcacgctggacnctgaagtatgttgacttagtttacttactcgtacaaactataccgtaccgaggtcggcccggtccgggggccttaccggtttccggccgtagggaccgtaaaggtcggaatacacgaaaacgacgtacggtcggctagaaccacgtacttctagtcttcactttccc

SEQ ID NO: 304257 - DNA, 637 bp, Homo sapiens
  misc_feature: GZ8MTXP02IE2HU.10.43.D10.1.454.CMB.2.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgtggcncctagtagcctggaccaanagaacctggcaggctccacgcccctnatctatggtncatccaagngggccacgtggcactcccagcccaggttcagtggccagtgggtctggggacagcttcacgtctacaccatcagcacgcgtaggagaccngaaagtatggttagaccgttaagtttaatttaactaggttaccaaactacgttcgtaaacccggtagttacgggcccggttaccgggggaccttaaccgtttccgggaccccggttaggggtaaacccaaaacgggttagggtaactttaaacggtaaccgaaaaaacgaccgttaaggtacggttccggtacgaaccgtaaaccgtaacgttacgttcgttccctttactaaccggtttccccg

SEQ ID NO: 304258 - DNA, 581 bp, Homo sapiens
  misc_feature: GZ8MTXP02FGC6E.10.43.D10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
  modified_base (572)..(572): a, c, t, g, unknown or other
  misc_feature (572)..(572): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctctgcagggccagtcagagtgttggcncctagtagcctggtaccaacagaaacctggccaggctcccaggccccctnatctatggtncatccaacnggggccactggcactcccagccaggtcagtggaccagtgggctggggacagacttcactctacacntcatcagctaggacgctgaagtactgttgctagtttacttactgttacaaactactacgtaccgtaggtcggtaccccggtccgggggtaccctaccgttccgggcccgttacggggaaccctaaaggtacggacttacgtacgaaaaccgtaacttacgggtacgtccgtacgaaccgacctactactgttacctacnctttccccg

SEQ ID NO: 304259 - DNA, 719 bp, Homo sapiens
  misc_feature: GZ8MTXP02JXZKZ.10.43.D10.1.454.CMB.2.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
  modified_base (473)..(473): a, c, t, g, unknown or other
  misc_feature (473)..(473): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgtggcnctagtagcctggaccaagacgaacctggccaggcctcccgacggcccctnatctagtggtgacactccgaaacgcgggacccagtcggaccactccccgagcccgtaggttccgaggttcggacccgtagggtggggtacgtaggggaactacgtaccttcaccttctacccgtacctattaccacttccgaacgcccgttaaggaccgtccgtaggtaaacgtagttgggttntaaccggtttaagtttttacttaacgttacgtaactaaacttacggttaaccggtaccgggtacgggttcccgggtacccgggttaccccggggggtccctttaacccgggtttcccggggacccggttaaccgggggtaaaaccgtaaaagggtccgggtaaacttaaccgaaaccggtaaaacggtacgtcgggtaccgacgttcgaaccaccgttagttctacgtcctttacaccgtttcccc

SEQ ID NO: 304260 - DNA, 690 bp, Homo sapiens
  misc_feature: GZ8MTXP02H6LW4.10.43.D10.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaangccaccctntcctgcagggccagtcagngtgtgctctagtanctgacangaactgcngcnccagccnatctagtgtncatccagacggcacgtggcatccagcctaggttcaggttcgaccgaggttcgggtaccgtaggggacctagggaaccctttctaaaccgttcctaccgtacccgtattacccaaagttcccgaaacgtcccgtagggtaaccgtaccctaggtaaaccgttagttacggttacgtaccgttaacggtttacttaacgttacgttaaccgaaaacgttacggttaaccgggttaacccgtacggggttaccggggtacccccgttaccgggggtaccccctttacggtttacccgggtaccccggtaggggtaaaccccgtaaagggttacggtacttaaccgtaacgaaacgtaacgttcggacgtccgagtaaccgccgttaagtccgtagtaccttactacgtttccccg

SEQ ID NO: 304261 - DNA, 553 bp, Homo sapiens
  misc_feature: GZ8MTXP02GUSKL.10.43.D10.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (429)..(429): a, c, t, g, unknown or other
  misc_feature (429)..(429): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctntcctgcagggccagtcagagtgttggcgcctagtagcctggtaccaacagaacctggccaggctccaggcccctnatctatggtncatccaacgagggcccacgtggccatcccagcccaggttcagtggccaggtcgggtctggggacaggtcttcactctcacccattcatcacgcctggacgctagaagatgttgctagtttatactgtacaacntcgtacgacgtgccgtccggggcctacgttcggcccgtagggaacccaaaggtcggtactagtaccaaaacggaactggtacgactcggaaccacctaattcgttgtccttactacgtttcccg

SEQ ID NO: 304262 - DNA, 665 bp, Homo sapiens
  misc_feature: GZ8MTXP02IJJGR.10.43.D10.1.454.CMB.2.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaangccacctctcctgcagggccagtcagagtgttggcgcctacgtacgctggtaccaacgaacgaacctggaccacgggcctccccgacggccccctacattcctagtcgggtnaccatacccgaaacgcggggacccacgtcggcacctcccgacgcccgtaggttccaggtcggccgtagggtcggggtctaggggacacggtacttcgacctctaccgacctatcagtacacgctggacgccgtaggaagtacgtgttgtacgtttagtttaacttacgttagtacaaactacgttaccgtacggtacggtccgggtcccggtcccgggggtcctacggtttcccggcccggtacgggtaaccgtaacggttacggtaactactaaccggtaaaacggaccgttacggtacggtactacggaaccgtactacgttcgttacggttccttactacgtttccccg

SEQ ID NO: 304263 - DNA, 696 bp, Homo sapiens
  misc_feature: GZ8MTXP02IA9TE.10.43.D10.1.454.CMB.2.raw
  modified_base (236)..(236): a, c, t, g, unknown or other
  misc_feature (236)..(236): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagcatagtagtgcacgaccggtgctcgattttagactagcagtaagggggaggaactgctcagttaggacccagagggaaccatggaagccccagctcagcttctcttcctcctgctactctggctcccagtttcagataccacggagagattgtgttgacacagtctccagccaccctgttctttgtctaccgaggggaaagacgcccacctctcctgcgagggccagtcagngtgtggcgcgtagtacgcgtcggtaccaacgaagaaccgtggccacggcctcccgacggccccctanacttctagtggtnaccgtactacccgaaacggaccgggacccacgtaggacctaccgtaccccacgccggtaaggttcgacggttggggcgtacggggttcggggtacgtgggggaacctaggtacctttcaccttctacccacctatcactctacgcgnggacnccgtagagtntgttgacttagtttactcgtaatataacgacgttacggtaccgtgggtacccggtcccggggtaccggggtacttacccggttccgggtacccggtaaggggtaaaccgtaacgggtagaaacgttacctaaaaccggaaaccggttaaggtcggtcggtacctacgggtccctaaactacggtttcctacggtttccttacgtttccttacccccgg

SEQ ID NO: 304264 - DNA, 519 bp, Homo sapiens
  misc_feature: GZ8MTXP01C0K72.38.6.A06.1.454.CMB.2.raw
  modified_base (363)..(363): a, c, t, g, unknown or other
  misc_feature (363)..(363): n is a, c, g, or t
  modified_base (487)..(487): a, c, t, g, unknown or other
  misc_feature (487)..(487): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaagcccctaagctcctgatctatgctgcctccactttgcaaagtggggtcccatcaaggttcagcgcagtgatcctgggacagatttcaactctcaccatcagcagcctgcagcctgaagtnttttagactaacttattactgtacaaactagtactttaaatagttatcctactacgtttcggacgggtaggaccaaagggtcgaagtactcgaaaacgtacttggtcggcttaggcttaaccgnttcctgtcttcattcttcccgccttaagtccg

SEQ ID NO: 304265 - DNA, 511 bp, Homo sapiens
  misc_feature: GZ8MTXP01D4SJK.38.6.A06.1.454.CMB.2.raw
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaagctcctgatctatgctgcctccactttgcaaagtcggggtcccatcaaggttcagcggcagtggatccgtgggacagtatttcaactctcacatcagcagcctgcagctgaagtntttgactaactttatacngtacaacagtactttaaatagtttatctactacgtttcgggcggtaaggaaccaagggtcagtactacaaaacgtattggtgctgccaccgnttcctgttccttcactccttcccgcttnttccg

SEQ ID NO: 304266 - DNA, 490 bp, Homo sapiens
  misc_feature: GZ8MTXP01EBVBV.38.6.A06.1.454.CMB.2.raw
  modified_base (366)..(366): a, c, t, g, unknown or other
  misc_feature (366)..(366): n is a, c, g, or t
  modified_base (462)..(462): a, c, t, g, unknown or other
  misc_feature (462)..(462): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaaagctcctgatctatgctgcctccactttgcaaagtgggtcccatcaaggttcagcgcagtggatcctgggacagatttcaactctcaccatcagcagcctgcagcctgaagtnttttgactaactttatactgtacaacagtctttaatagtttatctcgtactttcggcggagggaccaaggtcgagatcaaacgattgtgctgcacnttctgtcttcactcttccgccttaatcg

SEQ ID NO: 304267 - DNA, 517 bp, Homo sapiens
  misc_feature: GZ8MTXP01C2K7Y.38.6.A06.1.454.CMB.2.raw
  modified_base (333)..(333): a, c, t, g, unknown or other
  misc_feature (333)..(333): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcaagacaaaaaccagggaaagcccctaaagctcctgatctatgctgccctccactttgacaaagtcggggtacccatcaaggttcagcggcagtggatcctgggacngattcaactctcaccatcagcagcctgcagcctagaagtattttgactaaacttattactgtacaactagtctttaaatagtttaatctcgtaactttcgggcggaggaaccgaggtcgaagactacaaaagtacttgtacggcttagcaccgnttcctgtcttnactcttacccgcaagttcc

SEQ ID NO: 304268 - DNA, 567 bp, Homo sapiens
  misc_feature: GZ8MTXP01D2WCR.38.6.A06.1.454.CMB.2.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (383)..(383): a, c, t, g, unknown or other
  misc_feature (383)..(383): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcaagacaaaaccgagggaaacncccctaagctcngatctatgctgcctccactttgactaaaggtcgggtacccatcgaaggttcaggcggacaggtggaactccgtaggggactagtactttcaactctcaccatcagcagcctgcagctagaagtntttgactaaatttatactgtacaactagtacttaaatcgtttaatcctacgtaacgtttcgggacggtaacggaacctaaagggtccaaagtaataccgaaaacggtacttgggttacgctacgacttaacccgttnttcccgttnttcctttcaacgttcctttacccccgccttaagttccg

SEQ ID NO: 304269 - DNA, 547 bp, Homo sapiens
  misc_feature: GZ8MTXP01BQ9CK.38.6.A06.1.454.CMB.2.raw
  modified_base (236)..(236): a, c, t, g, unknown or other
  misc_feature (236)..(236): n is a, c, g, or t
  modified_base (534)..(534): a, c, t, g, unknown or other
  misc_feature (534)..(534): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaacngggaaacgccctaagctctgatctatgctgcctccactttgacgaaagtcgggggtacccatcgaaggttcaggcggcaggtggatccgtgggacagtactttcaactctcaccatcagcagtctagaccaactgaagtatttgactaacttactactgtacaacagtacgttacacggttaccgttctcgtaacgtttcgggcggtagggacctaaaggggtggaagactacgaaacgtaacgtggttgggccttggaccaaccgttattcgttacgttcttcaatttcccgtcccnctaattccgtaag

SEQ ID NO: 304270 - DNA, 598 bp, Homo sapiens
  misc_feature: GZ8MTXP01EDCYJ.38.6.A06.1.454.CMB.2.raw
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcaagacaaaacagggaaancccctaagctctgatctatcgctgccctcctactttgacgtaaaggtcggggtacccagtcgaaaggtttcaggtcggcaaggtggactccgtagggactagtactttcaacttctcacatcagcagctgcagtcctagaagtatttgactaacttattactgtaccaagtagtactttaaatagtttactcttacgtacgtttcgggacggtaacgggtaaccgtaaggtaccgtaagtaacttaacggaaaaacgtcggttaggtacgggactacggtacccaaccgttacttccgttcgttccttaaccgtaccttccccgtttacccgtaaccgttaacgtttaaccgg

SEQ ID NO: 304271 - DNA, 521 bp, Homo sapiens
  misc_feature: GZ8MTXP01AQW5V.38.6.A06.1.454.CMB.2.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaccngggaaancccctaagctctgatctatgctgcctcactttgcaaagtgggtcccatcgaaggttcagcggcagtggatccgtagggacagatttcaactctcaccatcagcagctgcagcctagaagtntttgactaatttattactgttacaaacagtacttaaagtacgtttaactccctagttaccgggtcggacggaaccggaagtcggaagactaacgaaacgaacgtgttggcngtacaccattcttcgtnttcaactcttcccgcctaattcgtaacg

SEQ ID NO: 304272 - DNA, 505 bp, Homo sapiens
  misc_feature: GZ8MTXP01EW8IW.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (370)..(370): a, c, t, g, unknown or other
  misc_feature (370)..(370): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagcagttatttagcctggtatcagacaaaaaccngggaaacncccctaagctcctgatctatgctgcctccactttgcaaaggtgggtacccatcaaggttcagcgcagtggatccgtgggacagtatttcaactctcaccatcagcagcctgcagcctagaagtnttttgactaactttatactgtacaactagtcttaaatacgtttaatctactacgttcggcggtacggaccaaggtcgagtactacaaacgtacttgtggctgcacnttctntcttcatccttccncttaacgtcg

SEQ ID NO: 304273 - DNA, 597 bp, Homo sapiens
  misc_feature: GZ8MTXP01DWLH7.38.6.A06.1.454.CMB.2.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacgagggaaacnccctaagctcctgatctatgctcgccctcctactttcgacgtaaaggtcggggtaccccagttacgtaaagggtttcaaggtcggacgtaggtcggaattccgtaggggactaggtactttcaaacttctcacctatcagcagcctgcagcctagtaagtatttgaacttaactttatactagtacaaacgtagtactttaaaggtatttacttaccttacgtacgtttcgggacggaagggtaaccgtaaggttcgaagtaacgtaacgaaaacgtacgttggtacggctacgcttaccgttattcttcgttaccttaactacttcccgttaccgccttaacttaaccgg

SEQ ID NO: 304274 - DNA, 593 bp, Homo sapiens
  misc_feature: GZ8MTXP01AW35C.38.6.A06.1.454.CMB.2.raw
  modified_base (244)..(244): a, c, t, g, unknown or other
  misc_feature (244)..(244): n is a, c, g, or t
  modified_base (537)..(537): a, c, t, g, unknown or other
  misc_feature (537)..(537): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacagggaacnccctaagctctgatctatgctgccctcctactttcgactaaaggtcggggtacccatcgaaggttcagcggcagtgactcgtgggactagtacttcaactctcaccatcagcagcctgcagtcctagtaacgtatttgaacttaactttacttacgtcgttacaaactagtactttaaagtagtttaactccttacgtaccgtttcgggcgggtaaacgggtaccctaaagggtcgaacggtaactaaccgtaaaacggtaacttgggtacggcttacggaacttacccgttntttaccgttcggttccttaacctacttcccttaccccgtaaccttaattaacccgg

SEQ ID NO: 304275 - DNA, 571 bp, Homo sapiens
  misc_feature: GZ8MTXP01EKV0S.38.6.A06.1.454.CMB.2.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagctggtatcaagacaaaacgagggaaacncccctaagctctgatctatgctgccctcactttgacaaggtcgggtaccatcgaaggttcaggcggcaggtgatccgtagggacagtattcaactctcacatcagcagctgcagctagaattatttgacttaactttatactgacaaactagttactttaaatagttactctacgtacgtttcggacgggaacggtaccgtaaggtaccgaagtaacgtaacgaaaacggtacgttgggtggttacccgtagacccttaaaccgttcttaccgtttcgttcctttaaccgtacctttcccttaccccgtaacgttaacgttaacg

SEQ ID NO: 304276 - DNA, 498 bp, Homo sapiens
  misc_feature: GZ8MTXP01DPSFE.38.6.A06.1.454.CMB.2.raw
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (389)..(389): a, c, t, g, unknown or other
  misc_feature (389)..(389): n is a, c, g, or t
  modified_base (454)..(454): a, c, t, g, unknown or other
  misc_feature (454)..(454): n is a, c, g, or t
  modified_base (491)..(491): a, c, t, g, unknown or other
  misc_feature (491)..(491): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaccaggaagcccctaagctcccgatctatgctgcctcactttgcaaagtggggtcccatcaaggttcagcggcagtgatcgtgggacagntttcactctcnccatcagcagcctgcagcctgaagtattttgactaaactttattactgtacaaacngtacttaataggtttatctactacgtttcggcggagggaccaaagggtcaagatcaaagaactgnggcttgcaccattcttagtcttcaattcctcccgctnttctaag

SEQ ID NO: 304277 - DNA, 543 bp, Homo sapiens
  misc_feature: GZ8MTXP01BWC7M.38.6.A06.1.454.CMB.2.raw
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcaagacaaaaaccagggaaacgccctaacccgctcctgatctatgctgcctccactttgcaaaggtcggggtacccagtcaaggttcaggtcggcaggtggatcgtgggacagtattcaactctcacatcagcagctgcagctagaagtatttgactaactttatactgacaactagtactttaaatagtttaactcttacgtaccgtttcgggacgggtaacgggaacctaaggtcgaaagtactacgaaaacggtacttggtacggntcgcttaccnttcctaagtccttcacttccgttcccgtcttaattccg

SEQ ID NO: 304278 - DNA, 513 bp, Homo sapiens
  misc_feature: GZ8MTXP01E17L5.38.6.A06.1.454.CMB.2.raw
  modified_base (340)..(340): a, c, t, g, unknown or other
  misc_feature (340)..(340): n is a, c, g, or t
  modified_base (501)..(501): a, c, t, g, unknown or other
  misc_feature (501)..(501): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaaagctcccgatctatgctgcctccatttgcaaagtggggtcccatcaaggttcagcggcagtggatctggggacagatttcactctcnccatcagcagcctgcagcctagaagattttgctaaacttattactgtacaaacagtactttaaatagtttaatctacaacgttttcggccggtagggaccaaagggtccgaagatcaaaaggaactgttaggcttgcaccagttcttgtcttcaatctccnctaattcgtaag

SEQ ID NO: 304279 - DNA, 535 bp, Homo sapiens
  misc_feature: GZ8MTXP01D160Y.38.6.A06.1.454.CMB.2.raw
  modified_base (394)..(394): a, c, t, g, unknown or other
  misc_feature (394)..(394): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaacgagggaaacgcccctaagctcctgatctatgctgcctctactttgacaaagtcgggtcccagtcaaggttcagcggcagtggatccgtgggacagtattcaactctcacatcagcagctgcagctagaacgtattttagacttaaacttattacgtntacaaactagtactttaaattagttactctacgtacgtttcggcggtaaggaacctaagggtccaagtactacgaaaacgtaattggtacgctacgcaaccgattctgttctaacgtactcccttcccgcttaattaaccg

SEQ ID NO: 304280 - DNA, 561 bp, Homo sapiens
  misc_feature: GZ8MTXP01EXJAZ.38.6.A06.1.454.CMB.2.raw
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgagggaaacncccctaagctcctgatctatgctcgccctctactttgacgaaaggtcggggtacccagtcgaaggttcaggcggcaggtggatccgtagggacagtattcaactctcacatcagcagctgcagctagaagtatttgactaactttatactagtacaaactagtactttaaagtagtttactctacgtacgtttcgggacggtaagggtaacctaaggtcgaagtaacgtaaccgaaaacgtaacgttggtcggcctaggacccttaccgttattcttcgtcttaactaccttccttacccgccttaattaaccg

SEQ ID NO: 304281 - DNA, 546 bp, Homo sapiens
  misc_feature: GZ8MTXP01BT5E6.38.6.A06.1.454.CMB.2.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaccngggaaancccctaagctctgatctatgctgcctcctactttgacaaagtcgggtacccagtcaagggttcaggcggcaggtggatccgtgggacagtattcaactctcaccntcagcagcctgcagcctagaagtnttttgacttaactttattactacgactaaactagttactttaaattagtttaatccttactaccgtttcgggccgggtaaggacccgtaaggtccgaaggtactaaccgaaaacggtacttgggtacgctagccaccgttnttcttntcttcnctcttccccgcttaagtcg

SEQ ID NO: 304282 - DNA, 536 bp, Homo sapiens
  misc_feature: GZ8MTXP01DDVQT.38.6.A06.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (367)..(367): a, c, t, g, unknown or other
  misc_feature (367)..(367): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccggcagtcaggcattagcagttattagcctggtatcagacaaaacnggaaanccctaagctccngatctatgctgcctcactttgacaaagtcgggtaccatcaaggttcagcgcagtgatccgtgggacagtatttcaactcgtcaccatcagcacgctgcagcctaggaatattttanacttaacttatactagtacaacagttactttaagtagtttactctacgtacgttgggacggaacggaaccgtaaggtcgaagtaactaaacgaaacggtacttggtcgacgtacgaccttaacgttnttcgttnttccttcctacgttccgttcccaacgttaacgtcg

SEQ ID NO: 304283 - DNA, 659 bp, Homo sapiens
  misc_feature: GZ8MTXP01DX8OG.38.6.A06.1.454.CMB.2.raw
  modified_base (166)..(166): a, c, t, g, unknown or other
  misc_feature (166)..(166): n is a, c, g, or t
  modified_base (239)..(239): a, c, t, g, unknown or other
  misc_feature (239)..(239): n is a, c, g, or t
  modified_base (611)..(611): a, c, t, g, unknown or other
  misc_feature (611)..(611): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtcacatcacttgccggcagtcaggcattagctagttattagctgtatcaagacaaaacgaggaaacnccctaagctctgatctatcgctcgcctcctactttgacgtaaaggtcgggtaccctagtacgtaacggtttcgaggtacggacgtaggtaggtacttccggtaggggtaactaggttactttaccgaaccttacctaacctaaacctattaccgacgtaccaacgggtccttacgggacctaacggtaccgttaaggtaaacgtttacttttacgaaacctttaaacttttactaacgtacgtaactaaacgtacgttactttaaagttacgtttactcgtaccgttacggttacggacggggtaacggtaaacccgtaggtacaaagtactaacgaaacgtacgttggacgttcgtacgaccttaacgttnttccgttaactcttaacgtcctccgttaccccgtcttaacgttaaccg

SEQ ID NO: 304284 - DNA, 530 bp, Homo sapiens
  misc_feature: GZ8MTXP01BC1O6.38.6.A06.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcaagacaaaaacgnggaaacnccctaagctctagatctatgcctcgcctcctagtttcgacgtaaaggtcgggtcccagtcgaaggttcaggcggactaggtgatccgtaggactagtatttccaactctcacatcacgtcacgcctgcagacctagaattcgtttgaacttaacttatacgntacaatagtactttaatagttatctactacggttcggnggtacgactaggtcaagtactacaaagacttggtgctgcaacttcgttctcttactcctacttcccgttccgaacttcgtaacg

SEQ ID NO: 304285 - DNA, 551 bp, Homo sapiens
  misc_feature: GZ8MTXP01DT7YE.38.6.A06.1.454.CMB.2.raw
  modified_base (245)..(245): a, c, t, g, unknown or other
  misc_feature (245)..(245): n is a, c, g, or t
  modified_base (399)..(399): a, c, t, g, unknown or other
  misc_feature (399)..(399): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacagggaaacncccctaaagctctgatctatgctgcctcctactttgacaaagtcggggtacccagtcaagggttcagcggacaggtggatccgtgggactagtactttcaacttctcacatcagcacgctgcagtcctagaatatttcgaacttaacttatacngtacaacgtatacttaaagttagtttactctacgtacgttcgggcggtaacgggtaccaaggttccgaagtactaacgtaaaacgtaagttgtacggcttacggacacgttnttccggttntccttctactcccttcccgcttcggttaacg

SEQ ID NO: 304286 - DNA, 540 bp, Homo sapiens
  misc_feature: GZ8MTXP01EFLO6.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagcagttatttagcctggtatcagacaaaaaccagggaaacgcccctaagctcctgatctatgctgcctccactttgcgaaaggtcggggtcccatcaaggtttcagcggcagtggatccgtgggacagtatttcaactctcaccatcagcagcctgcagcctagaagtattttgacttaactttatactgtacaactagtactttaatagtttatcttacgtacgttcgggacggtagggaacctaaggtcgaagtactacgaaaacgtacttggtcggctgccaccttgttccttgttaccttcacttcccgttccccgtaacttaacttaacg

SEQ ID NO: 304287 - DNA, 547 bp, Homo sapiens
  misc_feature: GZ8MTXP01CKYE8.38.6.A06.1.454.CMB.2.raw
  modified_base (247)..(247): a, c, t, g, unknown or other
  misc_feature (247)..(247): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcaagacaaaaccgagggaaacncccctaagctcctagatactatcgcctagccctacctactttgacgtaaaggtcgggggtaccccagttcgaaagggtttcagggcggcaggtggactccgtaggggactaggtatttcaaacttcctcaccagtcagcacgctgcagctagacgttatttgacttacttatacagttacaactagtactttaatagttactctactacggttcggacggtacggaaccgtaggcgtaagacgtaacaaacggtattcggagctaggcttacttnttctntctctctccttcncttcgtg

SEQ ID NO: 304288 - DNA, 534 bp, Homo sapiens
  misc_feature: GZ8MTXP01A835R.38.6.A06.1.454.CMB.2.raw
  modified_base (409)..(409): a, c, t, g, unknown or other
  misc_feature (409)..(409): n is a, c, g, or t
  modified_base (504)..(504): a, c, t, g, unknown or other
  misc_feature (504)..(504): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaccgagggaaacgcccctaagctcctgatctatgctcgccctcctactttgactaaacggtcgggggtaccccatcgtaaggttcaggtcggcgaggtggatccgtgggactagtacttcaactctcacagtcagcacgctgcagtcctagaagtatttgacttaacttattacngtacaacgtagttacttaaatagtttactctacgtacgttcggcggaggaaccaaggtcgagtatacaaacgtattggtgacgtcgacttaccgnttctgttactcactccttccgcttgtaacg

SEQ ID NO: 304289 - DNA, 559 bp, Homo sapiens
  misc_feature: GZ8MTXP01EMCE2.38.6.A06.1.454.CMB.2.raw
  modified_base (243)..(243): a, c, t, g, unknown or other
  misc_feature (243)..(243): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (519)..(519): a, c, t, g, unknown or other
  misc_feature (519)..(519): n is a, c, g, or t
  modified_base (553)..(553): a, c, t, g, unknown or other
  misc_feature (553)..(553): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagctggtatcagacaaaacgaggaaacnccctaagctctgatctatgctgccctcctactttcgacgtaaacggtcgggtacctagtcgtaacgggtttcaggcggctaggtggactccgtgggactagtctttcaacttctcactagtcacgcagctgacngctagagttntttagacttaactttntactgtacaactagtactttaagtagtttctctacgttacgttccgggcggtaacggtaactaggttacgaagtaacctacgaaaacggtacttggtacggctagaccttacgttnttacctgttcctcgtactccgttccctaacgttnttccgg

SEQ ID NO: 304290 - DNA, 514 bp, Homo sapiens
  misc_feature: GZ8MTXP01BZ5OL.38.6.A06.1.454.CMB.2.raw
  modified_base (368)..(368): a, c, t, g, unknown or other
  misc_feature (368)..(368): n is a, c, g, or t
  modified_base (480)..(480): a, c, t, g, unknown or other
  misc_feature (480)..(480): n is a, c, g, or t
  modified_base (504)..(504): a, c, t, g, unknown or other
  misc_feature (504)..(504): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccgagggaaacgcccctaagctcctgatctatgctgcctcactttgactaaagtcgggtcccagtcaaggttcaggcgcagtggatccgtgggacagatttcaactctcacatcagcagctgcagctagatntttgactaattatactgtacaatagtactttaaagtacgtttatctactacgtttcgggcggaaggtaccaaggttcgaagtactacgaaacgtattggtcgctagcacttnttcctgtcctctactcccgttccnccttgttccg

SEQ ID NO: 304291 - DNA, 600 bp, Homo sapiens
  misc_feature: GZ8MTXP01BJURP.38.6.A06.1.454.CMB.2.raw
  modified_base (167)..(167): a, c, t, g, unknown or other
  misc_feature (167)..(167): n is a, c, g, or t
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggcagtcgagggcattagctagttattagctggtatcaagacaaaaccgagggaaacnccctaagctctgatctatgctcgcctcctactttgacgtaaaggtcggggtacccatacgtaaagggttcacggcggacaggtggactccgtaggggacagtattcaactctcacatcagcacgctgacagcctagaagttatttacgacttaatttacttacacgtactaaactagttaactttaaaggttacgtttaacttccgttacgttacgtttacgggacgggtaacggtaaccgtaagggtaccaaggtaaactaaccgaaaacgtaacgttggtacggacttacgaaccttaccttgttccgttaattcctaactaccttcccttacccgaaccttaagttcccg

SEQ ID NO: 304292 - DNA, 545 bp, Homo sapiens
  misc_feature: GZ8MTXP01AFED7.38.6.A06.1.454.CMB.2.raw
  modified_base (245)..(245): a, c, t, g, unknown or other
  misc_feature (245)..(245): n is a, c, g, or t
  modified_base (367)..(367): a, c, t, g, unknown or other
  misc_feature (367)..(367): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaccagggaaacncccctaagctcctgatctatgctgcctccactttgacaaagtggggtcccatcaaggttcagcggcagtggatcgtgggacagatttcaactctcacatcagcagcctgcagcctagaagtntttgactaacttatactgtacaactagtactttaaatagttaattcctacgtacgtttccgggacggtacgggaccaaagggtccgaaggactacgaaaacgaacttcgggtaggcttacggccaccgttattcccttaagttccttctaacttcccgttcccgcccttaagttcccg

SEQ ID NO: 304293 - DNA, 585 bp, Homo sapiens
  misc_feature: GZ8MTXP01CRZQ6.38.6.A06.1.454.CMB.2.raw
  modified_base (167)..(167): a, c, t, g, unknown or other
  misc_feature (167)..(167): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggccagtcagggcattagctagttattagcctggtatcagacaaaacgnggaaacnccctaagctctgatctatgctgcctctactttgactaaaggtcgggtacccagtcgaaggttcaggcggcaggtgatccgagggactagtacttcaacttctcacctatcagtcagccctgacctagccgtagtaagttattttacgaacttaaaccgtttattaccgtacgttaactaaacgtagttaactttaaagttacgtttactacgttacgtacgtttcggggacggtaacgggaaccgtaaggtcgaagtactaacgaaaacgtacgttcggtaggcctagtaccacgttattcgtcttaccttcaaccttccttaccgccttaagttaaccg

SEQ ID NO: 304294 - DNA, 598 bp, Homo sapiens
  misc_feature: GZ8MTXP01B8MIR.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccgggcagtcagggcattagctagttattagcctggtatcaagacaaaacgagggaaacgcccctaagctctagatctatgctcgcctctacttgacgaaaggtcgggtacccagtacgaaggttcgaggcggacaggtgacgtccgtagggacagtactttcaacttctcacctatcacgcacgcctgcagtctaggtaattattttacgacttaaactttatactacgtacaactagttaactttaaggttactttactaccttacgtacggtttaccggacgggtaacggtaaaccgtaaggtacgaaagtactaaacgaaacggtagttcggtacgacgtacgtaccttaaccgttagttcctttgttaccttctaccgttcccttacccgtaaccttaacgttaaccg

SEQ ID NO: 304295 - DNA, 576 bp, Homo sapiens
  misc_feature: GZ8MTXP01AVJ2D.38.6.A06.1.454.CMB.2.raw
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
  modified_base (532)..(532): a, c, t, g, unknown or other
  misc_feature (532)..(532): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaacagggaancccctaagctctgatctatgctgcctccactttgacaaaggtcgggtacccagtcgaaggttcagcggcagtggatccgngggacagtatttcaactctcacctatcacgcacgcctagcagcctagaacgtatttgactaacttattacngttacaactagtacttaatagttactctacgtacgtttccgggacggtaacgggtaaccgtaagggttaccgaaaggtaacttaaccggaaacggtaaccgttgggtacggccttaggacccttaccgttattccgttnttacttaacctacgttcctttaccccgaacttaacgttaaccgg

SEQ ID NO: 304296 - DNA, 597 bp, Homo sapiens
  misc_feature: GZ8MTXP01B8TER.38.6.A06.1.454.CMB.2.raw
  modified_base (249)..(249): a, c, t, g, unknown or other
  misc_feature (249)..(249): n is a, c, g, or t
  modified_base (398)..(398): a, c, t, g, unknown or other
  misc_feature (398)..(398): n is a, c, g, or t
tcagtcgatcacgtcacgaccggtgctcgatttagatctactgacagggaggatggagactgggtcaactggatggcacatctggctcctgctgctctggctccaggtgccagatgtgccatccagttgacccagtctccatcctccctgtctgcatctgtaggagacagagtcaccatcacttggccgggccagtcgagggctattagctagtttattagctggtatcaagacaaaacgagggaaacnccctaagctctgactctatgctcgtcctcctactttgacgtaaacgggttcgggtacccagtacgtaaggttcacggcggacaggtggactcggtagggactagtactttcaaccttctcacatcgagcacgctgactagctagaattntttacgaactttaacgttacttacgtacgtaactaaacgtagttaactttaaattacgtttactaccgttaccgtaacgtttccggggacggtaacggaaaccgtaggttacgaagtaacgtaacgaaaaccgtagttggtacggctacgaccacgttcttcgttcgttcttcgtactcccgttaccgcttcgttaacg

SEQ ID NO: 304297 - DNA, 564 bp, Homo sapiens
  misc_feature: GZ8MTXP01DJTEJ.38.6.A06.1.454.CMB.2.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcaagacaaaaaccagggaaacncccctaagctcctgatctatgctgcctccactttgacaaaggtcggggtacccagtcgaagggtttcagcggcagtggatccgtgggacagatttcaactctcacatcagcagctgcagctgaagtatttagactaacttatactgtacaactagtactttaaagtacgtttatacttacgtaacgtttcgggacggtaaggaacctaagggtcgaagtactaacgaaaacgtaacgttggtacggcttacggccttaaacccgttgttacgttcgttaccttaacctacttcccgttaccccgtcgttaacgtcg

SEQ ID NO: 304298 - DNA, 580 bp, Homo sapiens
  misc_feature: GZ8MTXP01EXX7Z.38.6.A06.1.454.CMB.2.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccggcagtcagggcattagctagttattagcctggtatcaagacaaaaaccngggaaacncccctaaagctcctgatctatgctcgcctccactttagacgtaaaggtcggggtaccctagtacgaaggtttcaggcggcaggtggatcccgngggacagtattcaactctcaccntcancagctgcagcctagaagttatttgactaatttatactgtacaatagtacttaagttacgtttaactccgttacgtacggtttcgggacgggtaacggtaacccgtaagggtaccgaagtaacgtaaccgaaacggtaacgttcggtacggctcgtaaccacccttagttccgttcgttcttaacctacttcccgttaccccgtcttaagttccgg

SEQ ID NO: 304299 - DNA, 635 bp, Homo sapiens
  misc_feature: GZ8MTXP01BER4G.38.6.A06.1.454.CMB.2.raw
  modified_base (167)..(167): a, c, t, g, unknown or other
  misc_feature (167)..(167): n is a, c, g, or t
  modified_base (245)..(245): a, c, t, g, unknown or other
  misc_feature (245)..(245): n is a, c, g, or t
  modified_base (596)..(596): a, c, t, g, unknown or other
  misc_feature (596)..(596): n is a, c, g, or t
  modified_base (603)..(603): a, c, t, g, unknown or other
  misc_feature (603)..(603): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggcagtcagggcattagctagttattagcctggtatcaagacaaaacgaggaaacnccctaagctctagatctatgctcgtccctcctacgtttacgacgtaaacggtcggggtaccctagtacgtaacgggttcacggcggtactaggtggacgttccgtaggggactaaggtacttttcccaaacttcctccaacctacgtacacgtcacgtcctagactacgaccgtagtaagttactttacgaacctttaaactttacttactacgtaacctaaacgtagttactttaagtacgtttactaccttacgttaccggttcggacgggtaacgggtaacccgtaagggtaccgaaagtacgtaaaccgaaaacggtacgttggtacggacttacgacttaccgttnttccgtntccttctacgttccttacccgtcttgtaaccg

SEQ ID NO: 304300 - DNA, 596 bp, Homo sapiens
  misc_feature: GZ8MTXP01BRVVV.38.6.A06.1.454.CMB.2.raw
  modified_base (248)..(248): a, c, t, g, unknown or other
  misc_feature (248)..(248): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcaagacaaaaaccgagggaaacncccctaaagctcctgatctatgctcgccctcctacttttgacgtaaacggtcgggggtaccccagttacgaaacgggtttcacggcggcgtaaggtggaatcccgtggggactagtatttccaacttctcacatcagcagcctgccagcctagaagttactttgaccttaaatttntacgntacaatagtactttaatcgtttatcctacgtaacgtttcggggacggtacgggaacctaagggtccgtaaacgataaaccgaaaacgtacgttggtacgcttcggaaccaccgttattcctaagtttccttaacgtcctcccgtttaccccaacgttaattaacccg

SEQ ID NO: 304301 - DNA, 833 bp, Homo sapiens
  misc_feature: GZ8MTXP01D54LI.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcaagacaaaaaccgagggaaacgcccctaagctcctgatactatgcctgccctacctacttttcggacgtaaacggtcgggggtacccctaagttaccgtaaaacggggttttccaagggtccgggtacgtaagggttacgggggtaactttaccccgggttacggggggaaacctaagggtttaacttttttaccccgaaaaccctttccctttaaccgaaaccccgtaactttaacccgaaacgggtccctaaaccggggaccctttcgggaaccctaacggggttaccccttaagggtaaacggtttatttttacggtaaaccctttaaaacgtttttaaactttaaccttaaggttaaaccctaaaaccggttaagttaaccctttttaaaaggtttaaacgttttaactttaccgtttaaccgttaaccgggttttacccggggaacggggttaaaccggggaaacccgtaaaggggttaacccgaaggtaacttaaccgaaaaaaccgttcggttggtccgggttcgttacggaccttaccgttactttcggtaacgtttaccttcgtaaccttcccttacccggtccgttaactttcccgg

SEQ ID NO: 304302 - DNA, 599 bp, Homo sapiens
  misc_feature: GZ8MTXP01D2S3F.38.6.A06.1.454.CMB.2.raw
  modified_base (166)..(166): a, c, t, g, unknown or other
  misc_feature (166)..(166): n is a, c, g, or t
  modified_base (357)..(357): a, c, t, g, unknown or other
  misc_feature (357)..(357): n is a, c, g, or t
  modified_base (559)..(559): a, c, t, g, unknown or other
  misc_feature (559)..(559): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtcaccatcacgttgccgggccagtcagggctattagctagttattagcttggtatcaagacaaaaaccgagggaaacaccctaagctactgtatctatgctcgcctactacgtttgacgtaaacggtcgggtaccagtacaaggttcaggcgacgtagtgactcgtaggatagtattcaacttcncacatcacgcacgtctagctacgtcgtagtaagttcttttacgaaccttaaattttaatacctagtaacctaaacgtagttacttaaagttcgttataccgtcgttaaccggtttcgggaacgggtaaacggtaccgtaaggttaccggaataaacgtaaccgaaaacgtgtttcggaacggttctacggaacttaccgttnttcgttcttactctacgttccttccgtccttaagtaaccg

SEQ ID NO: 304303 - DNA, 624 bp, Homo sapiens
  misc_feature: GZ8MTXP01BGQ0M.38.6.A06.1.454.CMB.2.raw
  modified_base (240)..(240): a, c, t, g, unknown or other
  misc_feature (240)..(240): n is a, c, g, or t
  modified_base (370)..(370): a, c, t, g, unknown or other
  misc_feature (370)..(370): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtaggagacagagtcacatcacttgccgggcagtcaggcattagctagttattagctggtatcaagacaaaacagggaacncccctaagctctgatctatgctgcctcctactttgacgtaaaggtcggggtcccagtacgaagggttcacgggcgacgaggtaggatcccgtaggggactagtactttccaactctccgactactcgacncgacgccgtgactacgtacgtagtaacgttatttacgaacttaactttacgtactagtactaaacttacgttactttaagttacgtttactaccgttacgttaccggttcgggacggtaaacggtacgtaagggtacgtaaagtaacgtaaacgtaaacggtacgttggtacgttcgtacgtaccttacgttcgttacgttaacgttccttaacgttacccgttcccgttacccgtaacgttaaccgttaacgg

SEQ ID NO: 304304 - DNA, 708 bp, Homo sapiens
  misc_feature: GZ8MTXP01B0M1Z.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtaggagacagagtcacatcacgttggccgggcagtcgagggctattagctagtttatttacgccgttggtactacgaacgaaacaaaaccggagggaaaccaccccgtaagcctacgtagtactacttagtcgtccttcgaccccttacctagttttacggaaccgtaaacgggttcccgggggtaaccctaacgttaccggtaaacgggtttaccgaacggggtaccggtaacggtaaggtcggggtaactttacccgggtacggggtaaactaggttaacctttccaaacccgttctaacccactacgtacgaacgccgtacgtccgtacgccgtacgtaccgttaagtaagtttaactttacgtaacttaactttaacgtttacacgtactaaactagtttaacttaagttactttctcgtacgtacggttcgggacgtacggacgtaaggtctaagtcaaagtaaacgtcggttggaacttcgtaacgtacaccgttgttctttcgtacttaaccgtacttcccgaccgtaacttaagtaaccg

SEQ ID NO: 304305 - DNA, 729 bp, Homo sapiens
  misc_feature: GZ8MTXP01D5GVI.38.6.A06.1.454.CMB.2.raw
  modified_base (166)..(166): a, c, t, g, unknown or other
  misc_feature (166)..(166): n is a, c, g, or t
  modified_base (245)..(245): a, c, t, g, unknown or other
  misc_feature (245)..(245): n is a, c, g, or t
  modified_base (398)..(398): a, c, t, g, unknown or other
  misc_feature (398)..(398): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtcaccatcacgttcgccgggcagtcgaggctattagctagttattagctggtatcagacaaaacgagggaacncccctaagctactgatctatcgactcgcctcgtaactttgaacgtaaacggtccggggtaccctattacgaaggtttccgaggtcggacgtaggtaggtacttccggtaggggaactacggttaacttccaaaccttctcaaccaatcggacncgtaacggccttacgacgtacggtacccttaagggtaaaccgtttacgtttacgtaaaccgtttaacgttttaaacgtaccgttaaccgtaaacctaaacggttaacgtttaaacgttttaaacggtttaacggttttacttaacccgttacccggtttaaccggggtttaccgggggaaccggggtaacggtaaaccggtagggtaaaccgtaacgtaaaccgtaaccgaaacggttcgttacgggtcgttaaccgtaccgtaccttaaccgttcttacccgttcgttaccttaaccgtccttaccccgttaccgtaaccgttaacgtcg

SEQ ID NO: 304306 - DNA, 541 bp, Homo sapiens
  misc_feature: GZ8MTXP01AE1K7.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (391)..(391): a, c, t, g, unknown or other
  misc_feature (391)..(391): n is a, c, g, or t
  modified_base (508)..(508): a, c, t, g, unknown or other
  misc_feature (508)..(508): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaacncccctaagctcctgatctatcgctgccctccacttttcgactaaaggtcggggtaccccagtcgaaggtttcaggtcggcaggtggactccgaggggactagtactttcaaacttctcacatcagcagcctgcagtcctagaatntttgactaactttatactcgactaacagttacttaaattagttactctacgtacgtttcggcggtaaggaccaagggtccaggactacgaaagtacttggtagcgttggccacgttnttctgttctctacgttccttcccgcttaatccg

SEQ ID NO: 304307 - DNA, 575 bp, Homo sapiens
  misc_feature: GZ8MTXP01A6KUN.38.6.A06.1.454.CMB.2.raw
  modified_base (248)..(248): a, c, t, g, unknown or other
  misc_feature (248)..(248): n is a, c, g, or t
  modified_base (394)..(394): a, c, t, g, unknown or other
  misc_feature (394)..(394): n is a, c, g, or t
  modified_base (537)..(537): a, c, t, g, unknown or other
  misc_feature (537)..(537): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccgggcagtcagggcattagctagttattagccttggtatcaagacaaaaaccgagggaaacncccctaaagctcctgatctatcgctcgcccttcctactttacgacgtaaacggtcggggtaccccagtacgaaagggttcaggcggcaggtggatccgagggacagtattcaactctcacatcagcacgctgcagcctagtaagtntttagaacttaaactttatacgtatactaacgtagttaactttaagtacgtttactcctacgtaacggttcgggacgggtaacggtaaccgtaggtccgaagtaacttaaccgaaacgtacgttgggtcgctacgcttaccgnttcgtgttactctacttcccttacccgcttaacgttcg

SEQ ID NO: 304308 - DNA, 675 bp, Homo sapiens
  misc_feature: GZ8MTXP01AWARC.38.6.A06.1.454.CMB.2.raw
  modified_base (166)..(166): a, c, t, g, unknown or other
  misc_feature (166)..(166): n is a, c, g, or t
  modified_base (241)..(241): a, c, t, g, unknown or other
  misc_feature (241)..(241): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagatcaccatcacttgccggcagtcaggctattagctagttattagctgtatcaagaacaaaacgaggaaacnccctaagctctagatctatgctcgtcctcctacgtttacgacgtaaacggtcggggtacccaagtacgtaacggttcgaacggtcggtacgtagggtcggtaacgtccccggtaggggtaactaaggttaacttttcccgaaacccttacccgttaaccaacccgtaacgtaccgaaacggtcccaacggtcccgttgaccgtacgtaccgtagtaaagttacttttagaaaccttaaacgtttattaactgtaaacctaagtaactactttaaacttagtttacttaccgtacgttaacggtttcggggaaccggtaaggtaacctaagggtacgaataacgtaacaaacgtagttggtacgttacctacgtaaccttacgttacttccgtaagttccctaacgtacttcccgttaccctaacttaagtaacg

SEQ ID NO: 304309 - DNA, 500 bp, Homo sapiens
  misc_feature: GZ8MTXP01A9GKH.38.6.A06.1.454.CMB.2.raw
  modified_base (365)..(366): a, c, t, g, unknown or other
  misc_feature (365)..(366): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccaggaaagcccctaaagctcctgatctatgctgcctccactttgacgaaagtgggggtacccaatcgaaaggtttcaaggcggcagtggatccgtagggacagtatttcaactctcaccatcagcagcnncancagagtattatataacttatactatacaanatataagtattatctactacgtcggacggaggacgaacgtagagacaacaaacgaacgngtgcgtgacacncttctntctctactcttacctccttcgtcg

SEQ ID NO: 304310 - DNA, 563 bp, Homo sapiens
  misc_feature: GZ8MTXP01A56KB.38.6.A06.1.454.CMB.2.raw
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
  modified_base (527)..(527): a, c, t, g, unknown or other
  misc_feature (527)..(527): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtaggagacagacgtcaccatcacgttggccgggcagtcgagggcattagctagttattagctggtatcaagacaaaacgagggaaacnccctaagctctagatctatgctcgcctctacgtttgacgtaaacggtcggggtacctagtacgtaacggttcgaggcggtacgtaggtggacttcggtagggactagtacttccaactctcacctancgacgtcacgctagcagctaggattnttagactaactttatactatactaanagttacttaattagttactcgtacgtacggttacgggcggtacggacgtaaggtcgaatacgtaacgaaacgtagttcggtcggactacgacttacgttnttcttcgtactcgtactccttcctaacttcgtaacg

SEQ ID NO: 304311 - DNA, 647 bp, Homo sapiens
  misc_feature: GZ8MTXP01EKWYL.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccgggcagtcaggcattagctagttattagcctggtatcaagacaaaacgaggaaacgccctaagctctgatctatcgctcgcctactacgtttgacgtaaacggtcgggtaccccagtacgtaaacgggtttcaggcggtacgaggtaggacttaccgtaggggaactagtacttttaccaaacttcctaacaacctattaccgaacgtcccgaacggtcccgttaaggcctaacggtacctaaggtaaacgttattttcggaaacttaaactttattacctagttaacaaacgtatactttaaagtagtttaactcttacgtacgttcggacggtaacggaaccgtaggttaccgaagtaacgtaacgaaaacggtcttgggtacggttacgtacggaccttaacgttacttcggttcttaaccttcgtacttcccttacccggaacttaacgttaaccg

SEQ ID NO: 304312 - DNA, 732 bp, Homo sapiens
  misc_feature: GZ8MTXP01BL3AX.38.6.A06.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccgggcagtcagggcattagctagttattagctggtatcagacaaaacnggaaacnccctaagctctagactctatcgctcgccctactactttgactaaggtcgggtaccagtacgaaggttcaggcgacgtagtaggacgtccgtagggactagtactttaccaacttcctaactactaccaacgttaccaacggtccgaacgggtccccttacgggacctaaaccggttaccgtaagggttaaaaggtttaccttttttaacgggaacctttaaaaccggttttaaacgttttaaccaacgggtttaaaccaaaacgggttaaccgtttaacgtttttaaaagtttacggttttaaactcccgtttaaccggttaaccgggtttaccgggggacgggtaaacggggtaacctaaggggtaccgtaaacgtaacgttaaacgaaaccgttagttggttcggaccttcgacccgttaccgttactttccggtttacgttccgtttacgtaacctttccccgttaaccccggttaacccgtttaacg

SEQ ID NO: 304313 - DNA, 696 bp, Homo sapiens
  misc_feature: GZ8MTXP01BDB1R.38.6.A06.1.454.CMB.2.raw
  modified_base (650)..(650): a, c, t, g, unknown or other
  misc_feature (650)..(650): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttcgccggaccagtcgaggcattagctagttattagctggtatcagacaaaacgaggaacgccctaagctctgatctatgctcgtcctacctactttagacgtaacggtcgggtacccagtaccgtaaagggtttcacgggtccggacgtaggtcgggtacttcccggtacggggactaacggttaccttttaccaaacccttcccgtcccaaaccgtactaccgaacgccgtaaccggccttacggaccgtaacggtacccgttaagggtaaacgtttacgttttacggaaaccctttaaaacgttttaacttaaccgttacgttaacctaaaccgtaattaccgttttaaagtacgtttaacttcctacgttacggttacccggggacggtaacggggaaccgttaagggtacgtagtaacgtaacgtaaacgtacttgggttacgcgtacgtacttaaccgttnttccgttcttcttaaccgtcttcccgttacccgtaacttaacgtcg

SEQ ID NO: 304314 - DNA, 663 bp, Homo sapiens
  misc_feature: GZ8MTXP01BU8HS.38.6.A06.1.454.CMB.2.raw
  modified_base (250)..(250): a, c, t, g, unknown or other
  misc_feature (250)..(250): n is a, c, g, or t
  modified_base (612)..(612): a, c, t, g, unknown or other
  misc_feature (612)..(612): n is a, c, g, or t
  modified_base (654)..(654): a, c, t, g, unknown or other
  misc_feature (654)..(654): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacgttgccgggcagtcagggcattagctagttattacgcctggtatcaagaacaaaaccgagggaaacncccctaagctaccgtgactctagtcgcctcgtccctacctagtttcgacgtaacggtcgggtacccctagtaccgtaaggtttccgaggtccggacgtaggttggtacttaccggtcggggaactagttaccttttccaaacccttcctaaccaaccctataccgacgaccgtacgtccttagacctacggtaccgttaggtaaacgtttacgtttacgtaaccgtttaaactttacttacgtacgtaacctaaaccgtagttaactttaaagggttactttattacccgttacggttaccggtttaccgggaacggacggtaaaccgacgttacgaagtaacctacgaaacgtagttacgnggttactcgcttacttgttctgtctaactctccgttaccctnttcgtaacg

SEQ ID NO: 304315 - DNA, 719 bp, Homo sapiens
  misc_feature: GZ8MTXP01DL20A.38.6.A06.1.454.CMB.2.raw
  modified_base (251)..(251): a, c, t, g, unknown or other
  misc_feature (251)..(251): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatccctccctgcttttgcatctggtaggagacagagtcaccatcacttcggccgggccagtcgagggctagttagctagtttattacgctggtatacaagaacaaaacgnggaaacaccctaagctactagatctagtcgactcgtaccctactacgtttcgaacgttaaacggtcgggtaccctagtacgtaacgggttcgaggtcggtacgtaaggtcggtactacggtacgggtactagttacttcctaaacttcctaacaacctagtacccgaagccgaacgtccgttagaccgtacgtaccgtaaggtaacgtttacgtttacaaacttaactttaagtacgtaacgttaacctaacgttaaagttaacctttaaaggtttaacggtttaaccttaccgttaccggttaaccgggtttacgggaaccggggtaaacgggtaaacccgtaagggtacgtaaacgtaaccgtaaaccgtaaacgggtaacgttcggtacggttactacggaccttaaacgttcgtttcgtctttaccttcgtaccttccgttaccgtaacttaacgggttaaccg

SEQ ID NO: 304316 - DNA, 678 bp, Homo sapiens
  misc_feature: GZ8MTXP01BHITB.38.6.A06.1.454.CMB.2.raw
  modified_base (167)..(167): a, c, t, g, unknown or other
  misc_feature (167)..(167): n is a, c, g, or t
  modified_base (644)..(644): a, c, t, g, unknown or other
  misc_feature (644)..(644): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagatcacatcacttgccggcagtcagggcattagctagttattagcctggtatcagacaaaaaccagggaaacgccctaagcctctagtactcgtaactggcctcgtcccttaccgtacttttcgaccgtaaaacggttcgggggtacccctagttacgtaaacgggtttcgaacggcggtactaagggtcgagttccccgagggtactaaggttactttaccgaaaccttccgttaaccaaccgtatccgaacgaccacggtcctacggacctacgaccgttaggtaaacggtttacttttacgggtaaaccttaaccgtttagttaaaccctggtaaacctaaacgtgttaaaccttttaggggttaacgtttaacgttccttacggttaaccgttcgggacggggtaacgggtaacccgtagtacgaagtacctaaaggaaacgtcggttgtcggttcttcgacttacgttnttccgtaatcgtaactcgtcttaccctcttgtcg

SEQ ID NO: 304317 - DNA, 602 bp, Homo sapiens
  misc_feature: GZ8MTXP01D2GAK.38.6.A06.1.454.CMB.2.raw
  modified_base (248)..(248): a, c, t, g, unknown or other
  misc_feature (248)..(248): n is a, c, g, or t
  modified_base (447)..(447): a, c, t, g, unknown or other
  misc_feature (447)..(447): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttggccgggccagtcagggcattagctagttattagcctggtatcagacaaaaacgagggaaacncccctaagctctgtatctatcgctgcctcctactttgacgtaaacggtgggggtaccccagttacgaaagggttcaggcggcaggtggactccgtagggactaggtactttcgaaacttctcacctaatcgagtcagccctagcagcctagtagttatttgactaaacttatactgacaaatagtacttaaagtgttanctacgtacgttcgggacgggacggtaaaccgaagggtaccgtaagtaacgtaaccgtaaaacgtaaacgttgtacggttacgtcgtaaccaacccggttattcccgttaagtccttccgtaacttccccgttacccggaaccttaacgttaaccg

SEQ ID NO: 304318 - DNA, 550 bp, Homo sapiens
  misc_feature: GZ8MTXP02GB9VU.38.6.A06.1.454.CMB.2.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccgnggaaacncccctaagctcctgatctatgctgcctcactttgactaaagtcgggtcccatcaaggtcaggcgcagtggatccgtgggacagtatttcacttctcaccatcagcagcctgcagctagaatntttgactacttatactntacaactagtacttaaatacgtttatccttacgtacgtttcgggacggtaacggggacctaaagggtcgaaagtactaaccgaaaacgtacgttggtacggccttaggccctaaacctcgttactcgttaccttacgtaccttcccgtacccgactaacgtacg

SEQ ID NO: 304319 - DNA, 606 bp, Homo sapiens
  misc_feature: GZ8MTXP02I15VV.38.6.A06.1.454.CMB.2.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaccngggaaancccctaagctcctgatctatgctgcctcactttgcaaagtgggtcccatcaaggttcagcggcagtggatccgtgggacagatttcactctcaccatcagcagcctgcagcctagaacgtattttgactaaacttattactgtacaaactagtactttaaaatagtttaatccttacgtaaccgttttccggggacgggtaaacggggtaaccctaaagggggttcccgaaaggtaaacttaacgaaaaaaccggtaaccgttggggtacgggacccttagggaccctaaaccccgtaagttcccttggttaccctttaccgtaaacttcccctttaccccccggaccttaacggtttccccg

SEQ ID NO: 304320 - DNA, 574 bp, Homo sapiens
  misc_feature: GZ8MTXP02H04YW.38.6.A06.1.454.CMB.2.raw
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagctggtatcagacaaaacagggaaacnccctaagctctgatctatcgctcgcctccactttgacaaaggtcgggtcccatcgaaggttcagcggacagtggatcgtgggacngatttcactctcacatcagcagcctgccagcctagaactntttgactaacttnttactgtacaacgtatactttaaatagtttaanccttacgtacgtttcgggacggaacggggtaaccaagggttaccgaagtaacgttaaccgaaaacgtaccgttggtaacggtacccttaggtacccaacctaacgttccttaaggttaccctttacgaccgtttccctttacccccgacttaacttaccg

SEQ ID NO: 304321 - DNA, 551 bp, Homo sapiens
  misc_feature: GZ8MTXP02F9K4O.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (514)..(514): a, c, t, g, unknown or other
  misc_feature (514)..(514): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaacncccctaagctcctgatctangctgcctcactttgacaaagtcgggtcccatcaaggtcaggcgcagtggatcgtagggacagtattcacttctcaccatcgagcacgcctagcacgtacctagaaagttacttttgaacttaaactttaattacgtgtacaacgtatactttaaagttatttactctacgttaaccgttcgggacggaacgggtaccaagggtcgaagtactaagaaaaccgtgttcggtggactacgacctaacctnttcgtcgttacttactacttcccgtaccgactactcg

SEQ ID NO: 304322 - DNA, 600 bp, Homo sapiens
  misc_feature: GZ8MTXP02GGJDR.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaacncccctaagctcctgatctatgctgcctcactttgacaaagtgggtcccatcaaggttcagcggcagtgatccgtgggacngtatttcacttctcacatcagcagcctgcagcctagaatntttagactaacttattactagtacaaactagttactttaaagttacgtttattcctacgttacgtttaccgggggacggttaaacgggaaccgtaaaggggtcgtaaacggtaacttaacgaaaaaccggtacgttggttacggggccttacggacctaacccgtaatttccgttaacggtttacctttaccgtaacttttccccgtaaccccggtccgttaaactttacccgg

SEQ ID NO: 304323 - DNA, 545 bp, Homo sapiens
  misc_feature: GZ8MTXP02G778K.38.6.A06.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccaggcagggcattagctagttattagcctggtatcagacaaaaaccngggaaacgcccctaagctcctgatctatgctgcctcactttgacaaaggtcgggtcccatcaaaggttcagcggnagtggatccgtgggacagtatttcactctcaccatcagcagcctgcagcctagaagtatttgactaaactttataactgtaccaaacaagtacttaaaattagtttactctacgtaacgtttcggggacggaacgggggtaaccaaaaggggtccgaaagaactaacaaaacgaaacgtagtaggcgtagacaccactactcgtcttactactccttcccgacctactacg

SEQ ID NO: 304324 - DNA, 518 bp, Homo sapiens
  misc_feature: GZ8MTXP02HVVBL.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccggaccagtcagggcattagcagttattagcctggtatcagacaaaaccagggaaagcccctaagctcctgatctatgctgcctccactttgacaaagtcgggtccatcaaggttcagcgcagtggatccgtgggacagtactttcactctcaccatcagcacgcctgcagcctagaacgtattttgactaactttatacgtgtacaacagtctttaaatagtttactctactacgtttcggcgaagggacctaagggtcgaagtactacgtaaaacgacgttggtcgtacgtacgaccacctatcgtgtctcacttcctcccgctactcg

SEQ ID NO: 304325 - DNA, 543 bp, Homo sapiens
  misc_feature: GZ8MTXP02IY9SC.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaaccgagggaaacgcccctaagctcctgatctatgctcgcctcactttgacaaagtcgggtcccatcaaggttcagcgcagtggatcgtagggactagtactttcacttctcaccatcagcagcctgcagctagaagtatttgactaacttatactgtacaaatagtacttaaatagttactacttaccgtacgtttacggacgggaacgggtacctaaaggggtcaaagtaactaaccgaaaacgtacgtggtacggcctacgaccaacctatccgtgtcccttacactccttacccgcctattacg

SEQ ID NO: 304326 - DNA, 513 bp, Homo sapiens
  misc_feature: GZ8MTXP02FRB3M.38.6.A06.1.454.CMB.2.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (372)..(372): a, c, t, g, unknown or other
  misc_feature (372)..(372): n is a, c, g, or t
  modified_base (452)..(452): a, c, t, g, unknown or other
  misc_feature (452)..(452): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaancccctaagctcctgatctatgctgcctccactttgcaaaggtgggtcccatcaaggttcaggcggcagtggatccgtgggacagtatttcacttctcacatcagcagcctgacagccctagaacgtnttttgactaaactttattaacgtgtacaactagtacttaaatagttatctactacgtttcgggacggtaggactaaggtnaagtatacaaaacgactgtacggctcgacacctatctgtcttcgactccttcccgctatcg

SEQ ID NO: 304327 - DNA, 540 bp, Homo sapiens
  misc_feature: GZ8MTXP02HJOI4.38.6.A06.1.454.CMB.2.raw
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaacncccctaagctcctgatctatgctgcctccactttgacaaaggtcgggtacccatcaaggttcagcggcaggtggatccgtgggactagtatttcacttctcaccatcagcagcctgcagcctagaagtnttttgactaacttattactgtactaaacagtactttaaagtatttactcttactacgtttacgggaccggtaagggtaaccaagggtcgaaggtatacgaaaacggtactgggtacggctacgacctaactgtcttcgtacttcacttccttcccgactattccg

SEQ ID NO: 304328 - DNA, 545 bp, Homo sapiens
  misc_feature: GZ8MTXP02GUOOI.38.6.A06.1.454.CMB.2.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (318)..(318): a, c, t, g, unknown or other
  misc_feature (318)..(318): n is a, c, g, or t
  modified_base (379)..(379): a, c, t, g, unknown or other
  misc_feature (379)..(379): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgngggaaacncccctaagctcctgatctatgctgcctcactttgactaaaggtcgggtacccagtcgaagggttcagcggnaggtggatccgtgggactagtactttcactctcacatcagcagcctgcagcctagaacgtntttcgactaactttatactgtacaactagtactttaaagtacgtttatccttacgtacgtttcgggacggtaacgggtaccaaagggtcgaagtactacgtaaaacgacgtggtacggctcgacctaccgtattcgtgttccttactacttccgtcccactactcg

SEQ ID NO: 304329 - DNA, 546 bp, Homo sapiens
  misc_feature: GZ8MTXP02I3D0W.38.6.A06.1.454.CMB.2.raw
  modified_base (244)..(244): a, c, t, g, unknown or other
  misc_feature (244)..(244): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaccaggaaacnccccaagctcctgatctatgctgcctccactttgacaaaggtcggggtcccaagtcgaaagggttcaggcggcagtggatcgtgggacagatttcacttcncacatcagcagcctgccagcctagaagtntttgactaacttacttaactgtacaactagtacttaatagttactctactacgttcggacggtacggacgtaaggtcgaagtataacgaaacgtaacgtggtacgggacttacggaccaacccgtattcctaagttcccttacacgttccccttcccgtaccctagttaccg

SEQ ID NO: 304330 - DNA, 531 bp, Homo sapiens
  misc_feature: GZ8MTXP02JZGRM.38.6.A06.1.454.CMB.2.raw
  modified_base (246)..(246): a, c, t, g, unknown or other
  misc_feature (246)..(246): n is a, c, g, or t
  modified_base (371)..(371): a, c, t, g, unknown or other
  misc_feature (371)..(371): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaacncccctaagctcctgatctatgctgcctccactttgacaaagtggggtcccatcaaggttcagcggcagtggatccgtgggacagtactttcactctcaccatcagcagcctgcagcctagaagtntttgactaaactttattactgtacaaactagtactttaaatagttatctactacgtttcggacggtaagggacctaaggtccgaagtactacgaaaacgacgtggtacggactcgacctaacctatcttaagtctttacacttccttacccgctattccg

SEQ ID NO: 304331 - DNA, 514 bp, Homo sapiens
  misc_feature: GZ8MTXP02I4BLO.38.6.A06.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (482)..(482): a, c, t, g, unknown or other
  misc_feature (482)..(482): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaancccctaagctcctgatctatgctgcctcactttgcaaagtggtccatcaaggttcagcgnagtggatctgggacagatttcactctcacntcagcagctgcagcctgaagtntttgactaacttataactgtaccaatagtactttaaatagtttatcctagtaacctttcggggacggaaggggacctaaagggtctaagattacgaaaacgacttgtcggacttacgcaacctntcgtcgtcttactacttcctaccgcttactcg

SEQ ID NO: 304332 - DNA, 519 bp, Homo sapiens
  misc_feature: GZ8MTXP02HKF01.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaagctcctgatctatgctgcctccactttgacaaagtgggtccatcaaggttcagcggcagtggatccgtgggacagtattcactctcaccatcagcagcctgcagcctagaacgtatttgactaacttattactgtacaaactagtacttaaattacgtttatcttacgtacgttcggacgggtaggaacaggtcaagtactacgaaaacgacttgacggctacgccaactagttctgtcttacacttccgttcccgacttactacg

SEQ ID NO: 304333 - DNA, 545 bp, Homo sapiens
  misc_feature: GZ8MTXP02ITVBA.38.6.A06.1.454.CMB.2.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtggggtcccatcaaggttcagtgcagtgatcngggacagatttcactctcacatcagcagcctgcagcctgaacgtnttttgactaactttattacctgtacaactagtactttaaagtacgtttaatccttacgtaacctttcggggacggtacgggtaaccgaaagggttccgaagtacttacaaaacggtaccgtaggttcggacttcggaccacctattctaagttccttactactcctttacccgctacgttccg

SEQ ID NO: 304334 - DNA, 551 bp, Homo sapiens
  misc_feature: GZ8MTXP02HRVB7.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaagcccctaagctcctgatctatgctgcctccactttgcaaagtcgggtcccatcaaggttcagcggcagtgatccgtgggacagatttcactctcaccatcagcagcctgcagcctagaagtattttgactaactttatactgtacaactagtactttaaatagtttactcttacgtacgtttcgggacggtagggaaccaaggtacgaagaactacgaaaacgtaacgttggtacggcttacgacctacctaattccctaaggttcctttactacgttccctttcccccggaccttaacgtttacccg

SEQ ID NO: 304335 - DNA, 499 bp, Homo sapiens
  misc_feature: GZ8MTXP02HVGO1.38.6.A06.1.454.CMB.2.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagcagttattagcctggtatcagacaaaaaccagggaaagcccctaagctcctgatctatgctgcctccactttgcaaagtcggggtccatcaaggttcagcggcagtggatccgtgggacagatttcactctcacatcagcagcctgcagcctgaagtntttgactaaactttntacngtacaacagtactttaaatgtttancttacactttcggacggtagggacaaggtcgagatacaaacgtactgtacggctacgctaccatcctgtacttcactcttcccgctattcg

SEQ ID NO: 304336 - DNA, 554 bp, Homo sapiens
  misc_feature: GZ8MTXP02JXGU3.38.6.A06.1.454.CMB.2.raw
  modified_base (237)..(237): a, c, t, g, unknown or other
  misc_feature (237)..(237): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatccctccctgtctgcatctgtaggagacagagtcaccatcacttgccgggccagtcagggcattagcagttattagctggtatcagacaaaaccnggaaagcccctaagctcctgatctatgctgcctccactttgacaaagtgggtacccagtcaaggttcagcggacaggtggatcccgtagggactagtatttcactctcaccatcagcagtccagcagcctagaacgtntttgactaaacttntacctgtacaaactgtactttaaatagtttaatcttacgtaacgtttcgggaggtacgggtaaccaagggttccaagtacaacgaaaacggtacttggacggtctacggaccaccctaattccgtaacgtaccctttcacttccttaccccgactaactttccgg

SEQ ID NO: 304337 - DNA, 548 bp, Homo sapiens
  misc_feature: GZ8MTXP02JG8RX.38.6.A06.1.454.CMB.2.raw
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaaacgcccctaagctcctgatctatgctgcctccatttgcgtaaagtggggtcccatcaaggttcagcggcaggtggatccgtgggacagtatttcacctctcaccatcacgcacgcctgcagcctagtaacgtnttttgactaacgtttattaccgtntacctaacagttactttaaattacgtttactcttacgttacgtttcgggacgggtaacgggaccgaaggtcgaagactacgaaaacgtactggtacggctcgaccactattcgtaacgtcttactacttccgttacccactactacg

SEQ ID NO: 304338 - DNA, 532 bp, Homo sapiens
  misc_feature: GZ8MTXP02JC9VX.38.6.A06.1.454.CMB.2.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaagccctaagctcctgatctatgctgcctccactttgcaaagtcggggtacccagtcaaggttcagcgcagtggatcgtgggacagtatttcactctcacatcagcagtctgcaactgaagtatttgactaacttactactgtacaaactagtacgttacagttaccgttntactacgtttcgggacggtagggaccaagggtggagtagtacgaaaacgtacttggacggctaggaccacctatccgttacgtcttactacttcccgttacccgcctaacttcgtaacg

SEQ ID NO: 304339 - DNA, 531 bp, Homo sapiens
  misc_feature: GZ8MTXP02HWGKJ.38.6.A06.1.454.CMB.2.raw
  modified_base (244)..(244): a, c, t, g, unknown or other
  misc_feature (244)..(244): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccggccagtcagggcattagcagttattagctggtatcagacaaaaaccagggaaacncccctaaagctacctgatctatgctgcctccactttgacaaaaggtggggtcccaatcaaaggttcaggcggacaggtggatccgtggggactagatttcactctcaaccatcagcagcctgcagcctgaagattttgactaaattntaacgtgtcaaaacngactttaaatagtttaatctctaacgtttcgggacggaacggggaaccaaaggggtcaagaaataacgaaaacgaactgtagcctagacactactctcgtctactactacctccctacctactcg

SEQ ID NO: 304340 - DNA, 528 bp, Homo sapiens
  misc_feature: GZ8MTXP02J42NA.38.6.A06.1.454.CMB.2.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtcctccatcctccctgtctgcatctgtaggagacagagtcaccatcacttgccgggcagtcaggcattagctagttattagcctggatcaagacaaaaccnggaaacgccctaagctcctgatctatgctgacctcactttgcgaaagtggtccatcaagttcagcgcagtgatcctggacngatttcacttcncaccacncngcncgctcgcacgtacgtagtagtattatactacttacttacttacgtactactatacttacttagttacttacgtacgtacgtacggtacggtacgggacggaacggtacgtacgaacgaacgtaacgtacgtacgtacgtcgtcgtctactactactcgttcttctcctacctccgtacctacgtcg

SEQ ID NO: 304341 - DNA, 553 bp, Homo sapiens
  misc_feature: GZ8MTXP02IQJWX.38.6.A06.1.454.CMB.2.raw
  modified_base (344)..(344): a, c, t, g, unknown or other
  misc_feature (344)..(344): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaacaggaacgccctaagctctgatctatgctcgcctccactttgacgaaaggtcgggtccatcgaaggttcagcggcaggtggatccgtagggactagtatttcacttcncacatcagtcagcctagcagcctagaagtattttagacttaactttattacgtacgtacaacgtagttaactttaaagttagtttaactccttacgtaaccgtttcggggacgggaacgggtaccgtaaaggtcgaagtactaacgtaaacgacgtaggtcggtacgcacactacttactcgttactctacttcctccctacacttacg

SEQ ID NO: 304342 - DNA, 560 bp, Homo sapiens
  misc_feature: GZ8MTXP02H8T1U.38.6.A06.1.454.CMB.2.raw
  modified_base (238)..(238): a, c, t, g, unknown or other
  misc_feature (238)..(238): n is a, c, g, or t
  modified_base (386)..(386): a, c, t, g, unknown or other
  misc_feature (386)..(386): n is a, c, g, or t
  modified_base (515)..(515): a, c, t, g, unknown or other
  misc_feature (515)..(515): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaagcccctaagctcctgatctatgctcgcctcctactttgactaaaggtcggggtaccccagtacgaaagggttcaggcggcagtggatccgtgggacagtatttcactctcaccatcagtccagcctgcagccctagtaagtnttttgactaactttattactgtacaatagtacttaatagttatcttctaacgtttcggacggtacgggtacaagggttcgaagtaactacgaaaacgtacgtaggtcgggtactcggacctaacccttnttacgttcgttaccttacgtaccgttccctcccgaccttacgtcg

SEQ ID NO: 304343 - DNA, 526 bp, Homo sapiens
  misc_feature: GZ8MTXP02IIE50.38.6.A06.1.454.CMB.2.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaccagggaaacncccctaagctcctgatctatgctgcctccactttgacaaaggtcggggtcccatcaaggttcagcggcagtggatccgtgggacagtatttcactctcacatcagcagcctgcagccctagaacgtattttgactaaactttattactagtacaaactagtactttaaattagtttaatcttacacgtttcggacggaagggaccaaggtacagaactacgaaaacgacttggacgctacgaccacctatcctgtcttactactccttcccgctactacg

SEQ ID NO: 304344 - DNA, 538 bp, Homo sapiens
  misc_feature: GZ8MTXP02IP8GS.38.6.A06.1.454.CMB.2.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagctggtatcagacaaaaaccgaggggaaacncccctaagctcctgatctatgctgcctcactttgacaagtcggtccagtcaggttcagtcggnaggtgatccgtgggacagtatttcactctccacatcagcagcctagcagcctagaaacgtntttcgattaaacttatactagtcaaagtatactttaaatatttancttacgtacgttcgggaacgggtacggaaccgtaaggtaccggaataactacgaaaacgtacttggacggctacgacaaccctgttctaacgttctactactcccttacccgctaacttcg

SEQ ID NO: 304345 - DNA, 565 bp, Homo sapiens
  misc_feature: GZ8MTXP02JV5N4.38.6.A06.1.454.CMB.2.raw
  modified_base (366)..(366): a, c, t, g, unknown or other
  misc_feature (366)..(366): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaaagcccctaagctcctgatctatgctgcctccactttgacaaagtcgggtccatcaaggttcagcggcagtcgatccgtggacagatttcactctcacatcagcagcctgcagcctagaagtntttgactaacttattaactgtactaactagttactttaaagttatttactacgttacgttacggttaccgggacgggtaacggtaaccgtaagggtacgaagtaacgtaacgtaaaacggtacgttacggtacggtctacgaccgtacctacgtacgttcgttacttactaccttaccgttacccgtaccgtacgtacg

SEQ ID NO: 304346 - DNA, 610 bp, Homo sapiens
  misc_feature: GZ8MTXP02HRA8J.38.6.A06.1.454.CMB.2.raw
  modified_base (248)..(248): a, c, t, g, unknown or other
  misc_feature (248)..(248): n is a, c, g, or t
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaaccagggaaacncccctaagctcctgactctatgctgcctccactttgcaaaggtcgggtccatcaaggttcagcggnagtggatcgtgggacagtactttcacttctcaccatcagcagcctgcagcctagaacgtnttttgactaactttattactagtacaaactagtactttaaattacgtttaatccttacgtaccgtttgggacgggtaacgggtaaccgaagggttccgaaaggtaacttaaccgaaaaacggtccgtttaagggtcgggtaccttacggtacccgaaacccgttacgtttccgttaaccgtttacccgtttactaacccgtttccccgtttacccccgtaccgtttaacgttccgg

SEQ ID NO: 304347 - DNA, 555 bp, Homo sapiens
  misc_feature: GZ8MTXP02JPJAB.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacgngggaaacncccctaagctcctgatctatgctcgcctccatttgacaaaggtcgggtacccagtcaaggttcaggtcggacagtggatccgtagggacagtactttcacttctcaccatcacgctacgcctgccagcctagaaagttnttttacgacttaacttattacgntacaaatagtactttaaatagttactctacgtaacgtttcgggacggtaacgggacctaaagggtcgaagtactaacgtaaaacggtactggtacggctacgaccaaccttgttctcgttacctactacttccctaccactacgtcg

SEQ ID NO: 304348 - DNA, 577 bp, Homo sapiens
  misc_feature: GZ8MTXP02IU2VQ.38.6.A06.1.454.CMB.2.raw
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagctggtatcagacaaaaccagggaaacgcccctaagctcctgatctatgctgcctccactttgacgtaaaggtcggggtcccatctaaggttcagcggcaggtggatccgtgggacagtatttcacttctcaccatcagcagcctgcagcctagaacgtntttgactaacttnttactagtacaaactagtactttaaagtagtttatacttctaacgtttcgggacggtaacgggaacctaaagggttccgaaaggtaactaaaccgtaaaaaccgtacgttggtcgggtactacggtaccaacctaattcgttaacgttccttaacctacgttcccctttacccgacttaacgtttccg

SEQ ID NO: 304349 - DNA, 584 bp, Homo sapiens
  misc_feature: GZ8MTXP02I4VTJ.38.6.A06.1.454.CMB.2.raw
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaccgagggaaacncccctaagctcctgatctatgctcgcctccactttgacaaaggtcgggtccatcgaaggttcaggcgacngtggatccgtgggacagtactttcactctcaccatcagcagcctgaccagcctagaagttctttgacttaacttattactagtacaactagtactttaaattacgttactccttacgtacggtttcgggacggtaacgggtaacgaacgggttacaaggacttaacgaaaaccggtagttaccggtaggaccttacgacctaaaccctattccgttaagttaccttaccgtacttcccctttaccccggaccttaacgtttaacccgg

SEQ ID NO: 304350 - DNA, 550 bp, Homo sapiens
  misc_feature: GZ8MTXP02HJ791.38.6.A06.1.454.CMB.2.raw
  modified_base (246)..(246): a, c, t, g, unknown or other
  misc_feature (246)..(246): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
  modified_base (541)..(541): a, c, t, g, unknown or other
  misc_feature (541)..(541): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaacncccctaagctcctgatctatgctgcctccactttgacaaaggtgggtacccatcaaggttcaggcggcaggtggatcccgtagggactagtatttcacttntcaccatcagcagcctgcagcctagaagtnttttgactaactttnttacgtgtaccaatagtactttaaagtagtttancttacgtaacgtttcgggacggtagggacctaaagggtcgtaagacttacgaaaacgtacgttggtacggcttacgacctaccgtatccgtaagttcctctactcccgttacccncgttactcg

SEQ ID NO: 304351 - DNA, 635 bp, Homo sapiens
  misc_feature: GZ8MTXP02J3046.38.6.A06.1.454.CMB.2.raw
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttcgacccagtcctccatcctcctgtctgcatcgtgtaggagacagacgtcaccatcacgttggccgggcagtcgagggctattacgctagtttattacgccgttaggtactacgaacgaaccaaaaaccgaggggaaactcccctaaagcctcctagtactctagtcgcctgcctacgtacgtttggacgtaaaggtcggtacccagttcgaagtcaggcgataggtggactccgaggactagtactttcacttcncgactacncgacgcncgtcgtcgacgtacgtacgtaagttaacgttacttacgactttaacttactacgtaacgtactaacgttagtttaactttaacgtacgttactaccgtacggttacggtacgggaacggtaacggaacgtagggtacaagtaaacgtaacgtaacgtacgtggacgtacgtacgacctaccgtacgttccgtaacgttacccgtactaccgtttacccgaccgtacgttacgtacg

SEQ ID NO: 304352 - DNA, 538 bp, Homo sapiens
  misc_feature: GZ8MTXP02H52ZJ.38.6.A06.1.454.CMB.2.raw
  modified_base (408)..(408): a, c, t, g, unknown or other
  misc_feature (408)..(408): n is a, c, g, or t
  modified_base (528)..(528): a, c, t, g, unknown or other
  misc_feature (528)..(528): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagccttggtatcagacaaaaaccagggaaacgcccctaaagctcctgatctatgctgcctccactttgactaaacggtcggggtaccccagtcaagggttcaggcggcaggtgatccgtgggacagtatttcacttctcaccatcagcagcctgccagcctagaatatttgactaacttattactagtcaanagtactttaaagtagtttatctactacgttcggacggaggtaccaaggtcgaagacttacgaaaacgtacgttaggcggtacacgtacacctatcttaagtccttacactttccctcccncttactacgg

SEQ ID NO: 304353 - DNA, 740 bp, Homo sapiens
  misc_feature: GZ8MTXP02IFT3G.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttggccgggccagtcagggcattagctagttatttagcctggtatcagacaaaacgagggaaacgcccctaagctcctgatcctatcgctcgccctaccacgttttcgacgtaaaacgggtcggggtaccccaagttaccgtaaacgggtttcaagggccggtacgaagggttgggaacttccggtacggggtaacctaggttacttttcaaccttcttaccaccctaatccgagcctaacggcccttcgggaccacggtccctaagggtaaacgtttacttttacgaaacctttaaaacctttttaaggtttaccgtaacgttaaccaaaccgttaagttaaaccttttaaaattacggtttttaactccctttacgttaaccggtttaccggggaacggggtaaacggggaacccgtaaaggggttcgaaagtaacgtaaccgtaaaacggtaaccggtttggcgggtacctacggtacctaaaccttcgttaccgttcgtttaaccctttcgttaaaccctttcccggttcccccgtactacgttttaacccgg

SEQ ID NO: 304354 - DNA, 587 bp, Homo sapiens
  misc_feature: GZ8MTXP02I5THI.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccngggaaacncccctaagctcctgatctangctgcctcactttgcaaagtcgggtccatcaaggttcagcgcagtggatcgtggacagtntttcactctcacatcgacncacgcctagcagtcctaggtaaattatttgaacttaactttatttacctagtaacctaaactagttaactttaaagttacgttttattccctacggttaacccgtttacggggaacgggtaacggggaacccgtaaagggttcgaaagtactaaaccgaaaacggtacttagggtcggtactacgaccaaccctagttaccgtcgttaccttactaccttcccgttacccgactacgttacg

SEQ ID NO: 304355 - DNA, 581 bp, Homo sapiens
  misc_feature: GZ8MTXP02IIFYS.38.6.A06.1.454.CMB.2.raw
  modified_base (167)..(167): a, c, t, g, unknown or other
  misc_feature (167)..(167): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (316)..(316): a, c, t, g, unknown or other
  misc_feature (316)..(316): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggcagtcagggcattagcagttatttagcctggtatcagacaaaaaccgngggaaacncccctaaagctctgatctatgctcgcctcactttgacaaaggtgggtcccatcgtaaggttcagcgganaggtggatccgtagggacagtatttcactctcacatcagcacgcctgacacgcctagaactattttagacttaaccgtttattactagtacaagtagtactttaaatacgtttaactccgttacgtaaccgtttccgggacggtaacgggtaccgtaaagggttaccgaaagtaacttaacgaaaacgtacgttaaggtcgaccgtacgacctaaaccgtcttacgtaagttctttacacgtttcccttacccgactaattcccg

SEQ ID NO: 304356 - DNA, 754 bp, Homo sapiens
  misc_feature: GZ8MTXP02IKZVA.38.6.A06.1.454.CMB.2.raw
  modified_base (167)..(167): a, c, t, g, unknown or other
  misc_feature (167)..(167): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (702)..(702): a, c, t, g, unknown or other
  misc_feature (702)..(702): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggccagtcagggcattagctagttattagcctggtatcagacaaaaaccgngggaaacnccctaagctctgactctatgctcgcctcctactttacggactaaaggtcggggtaccccaagttaccgtaaagggtttccaaggtccggacgtaacggtagggtaacgttcccggtaggggaacctaggttaacgttttaccaaccttacctacctaaaccctaacgttaccgaaacggccctaacggtccccgttacgggacctacggtacccgttaaggtaaaacggtttacgttttttaacggaacctttaaaaccttttaaggtttaaccctaacgggttaaccaaaacgttaaacggtttaccttttaaaagttacggttttaacttcccgttacggttaaacccgtttaccgggaacggggtaacgggtaaaccgtaacgggttacgaaacgtaacgttaaaccgaaaacgtaacgtttaggacggttacacggtacctaaaccgttnttaccgtaacgttaccttactacccgttaccgttaccctacgttaactaccg

SEQ ID NO: 304357 - DNA, 610 bp, Homo sapiens
  misc_feature: GZ8MTXP02HXYOF.38.6.A06.1.454.CMB.2.raw
  modified_base (249)..(249): a, c, t, g, unknown or other
  misc_feature (249)..(249): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttatttagctggtatcaagacaaaaaccgaggggaaacncccctaaagctcctgatctatgctcgcctcctatttgactaaaggtcggggtacccagtacgaaagggttcaaggcggacaggtggatccgtagggactagtatttcactctcacatcagcacgctgacngcctagtaacgtatttcgacttaaactttnttaacgtnttaccaaactagttacctttaaattacgttttaactcgttaccgtacggttttacgggaccggggtaacgggaaccgtaaagggttaccgaagtaaacctaacgtaaaaccggtacgtttggtacggcttacggacctaaccgtattccgttcgttaactttcactttcccgttaccccgctttaacgtccgg

SEQ ID NO: 304358 - DNA, 554 bp, Homo sapiens
  misc_feature: GZ8MTXP02ILBOK.38.6.A06.1.454.CMB.2.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagctggtatcagacaaaacngggaaacncccctaagctcctgatctatgctgccctcactttgacaaaggtcgggtcccatctaaggttcaggcggctaggtggatccgtagggacagtatttcactctcacatcagctagcctgcagcctagaagtattttgactaaactttattacctgtacctaaagtagtactttaaatacgtttatccttacgtacgtttcgggacggtaagggacctaagggtccgaagtactaacgaaacgtaacgtggtacggactacgacctacctaattcgtaagttcctacgtacttcccgttcccgacttacgtccg

SEQ ID NO: 304359 - DNA, 544 bp, Homo sapiens
  misc_feature: GZ8MTXP02GLZHP.38.6.A06.1.454.CMB.2.raw
  modified_base (373)..(373): a, c, t, g, unknown or other
  misc_feature (373)..(373): n is a, c, g, or t
  modified_base (498)..(498): a, c, t, g, unknown or other
  misc_feature (498)..(498): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaagcccctaagctcctgatctatgctcgcctcctactttgactaaaggtgggtcccatacgaagggttcaggcgcagtggatccgtgggacagtacttcactctcacatcagcagcctgcagcctagaagtntttgactaactttataactgtacaactagtacttaatagttatctactaccgttcgggacgacgggtaaccagggtcgagtaactacgtaaaacgacggttgtacggctacgacctaacccgttnttacgttcgttaccttacgtacccttcccgtcccgaccttagtacg

SEQ ID NO: 304360 - DNA, 603 bp, Homo sapiens
  misc_feature: GZ8MTXP02HNOIG.38.6.A06.1.454.CMB.2.raw
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtaggagacagagtcaccatcacttcgccgggcagtcagggctattagctagttattagctggtatcagacaaaaacgagggaaacgcccctaaagctacctgatctatgctacgcctctactttgactaaaagtcggggtacccaagtacgaaggttcaagcgactaaggtggactcgtacgggatagtattcactctcacatcagcagctcgcacgactagtaagtattagtactaacttaacttactacgtactaacctataattaaagttaagttattacttacgtacgtttacggtacgggaacgggaacgtaacggtaccgaagaaacgttaacgaaaacgtaaaccgtacggttaggtacgtaacggaccgaacctaaccgtacgttaacgttacttccttaacgttaccccgttccccgtaccctacgttaacccg

SEQ ID NO: 304361 - DNA, 788 bp, Homo sapiens
  misc_feature: GZ8MTXP02JLRAN.38.6.A06.1.454.CMB.2.raw
  modified_base (167)..(167): a, c, t, g, unknown or other
  misc_feature (167)..(167): n is a, c, g, or t
  modified_base (244)..(244): a, c, t, g, unknown or other
  misc_feature (244)..(244): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcactcgccgggcagtcagggcattagctagttattagctggtatcagacaaaacgagggaaacncccctaagctctgatctatcgctcgcctcctacgtttacgacgtaaacggtcggggtaccctagtaccgtaaagggttcgacggcggtacgtaggtacggacgttcccggtaggggtaacctagttaactttttacccgaacctttaccctaccgtaaacccctaacgttaccgacgggtacccgaaccggtccccgtacggaacccgttaccgggttaccccgttaaaggggttaaaccttttacgttttttaaccggaaacccttttaaaaccgttttaacttttaaacccgttacggttaaacccctaaaagttaacggttaaacctttttaaaagtttaaacggttttacttaccccgtttaacgggttaacccgggttttaccgggggaaccggggaaaaccggggttaaacccggtaagggttacggaaacgtaactaaacggtaaaacggtacgtacgggtacggtacttacggaccctaacgtcgtttaccttaacgttaccttactaccgttccctacccggtacttacgtaccg

SEQ ID NO: 304362 - DNA, 648 bp, Homo sapiens
  misc_feature: GZ8MTXP02G55NW.38.6.A06.1.454.CMB.2.raw
  modified_base (245)..(245): a, c, t, g, unknown or other
  misc_feature (245)..(245): n is a, c, g, or t
  modified_base (642)..(642): a, c, t, g, unknown or other
  misc_feature (642)..(642): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacgaggaaacnccctaagctctgatctatgctgcctcctactttcgacgtaaaggtcggggtaccctagtacgtaaggttcgacggcggtacgaaggtggtaacgttcccggtaggggaactacggtactttccaccttctaccaacctactaccgacgtccgaacgccgtcgaccacgtacccgttaggtaaacgttactttttacgaacctttaaacctttaatttaactacgttaaccaaacgttaacggttacctttaaaatttacggtttacttaccgtttaccgtaaccggtttaccggggacgggtaacgggtaacctaaggggtccgaagtaacgtaacgaaaacgtacgtggtacggactacgactaacctgttactgttcctactacttccgtacccnctatcg

SEQ ID NO: 304363 - DNA, 706 bp, Homo sapiens
  misc_feature: GZ8MTXP02G0NA4.38.6.A06.1.454.CMB.2.raw
  modified_base (167)..(167): a, c, t, g, unknown or other
  misc_feature (167)..(167): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggcagtcagggcattagctagttattagctggtatcagacaaaacgngggaaacnccctaagctccngatctatgctcncctctacgtttgacgtaaaggtcgggtacccagttccgtaaagggttcaacggcggacgtagggtacggtaacttccggtacggggaactaacggttactttaccgaaccttcctaccaacctaacgtccgaacgtaccgacggtccctgggaccacgtcccgtaagtaaaggttacttttaacgaacctttaaactttacttaaccgtagtacctaaacgtaacggttaacttttaaagttacgtttaaactcccgtttacggtaaccggtttaccgggaacggggaacgggtaacccgtaaaggggttaccgaaagtaaacgttaaaccggaaaaccggtaacggttacggtcggtaaccgtacgaccgttaacccgtatttccgtccgtttacttaaccctacttccccgttacccgtaccttaacgtttcccgg

SEQ ID NO: 304364 - DNA, 555 bp, Homo sapiens
  misc_feature: GZ8MTXP02IF36A.38.6.A06.1.454.CMB.2.raw
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctcactttgcaaagtcgggtccatcaaggttcagcggnagtggatcgtgggacagatttcactctcaccntcagcaggcctgcagcctgaagtnttttgactaactttattactgtacaactagtcttaaatgttactctactacgttcggacggtagggtacctaaagggttcgaaggtaactacggtaaaaacgtacgtggtacgggtcttacggacctaaccctaagttcccttaaggttcctttactactttcccttaccccggtacctaactttacccgg

SEQ ID NO: 304365 - DNA, 660 bp, Homo sapiens
  misc_feature: GZ8MTXP02F1OKF.38.6.A06.1.454.CMB.2.raw
  modified_base (237)..(237): a, c, t, g, unknown or other
  misc_feature (237)..(237): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaacngaagaaacgccctaagctcctgatctatcgctcgcctcctactttgactaaacggtcggggtaccctaagtaccgtaaacggttcgaacgggccggacgtaagggttcgggtaaccgttcggtaggggaactaacggttactttacccaaccttcctacctaaccctattcccgagtccgaacggtccctagggacctaacggtccgttaaggaacgtttagttttacgaccttaaactttactaacgtacgtaactaaacgtactaatttaaacgtatttacttaccgttacgtaccggtttcggggaacgggtaacgggtaaccgtaagggtacgtaaagtaacgtaaacgtaaaacggtaccgttgggtacggcttacgaccacttactcgttcttcttccacctttccgtccgactacg

SEQ ID NO: 304366 - DNA, 582 bp, Homo sapiens
  misc_feature: GZ8MTXP02GHXKP.38.6.A06.1.454.CMB.2.raw
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaccgaggaaacncccctaagctctgatctatgctgcctcactttgacaaggtcggtccatcgaggttcagcggnagtggatccgtgggacagtactttcacttctcaccatcagcagcctgcagtcctagaagttnttttacgactaaactttattaccgtgtaccaacgtagtactttaaagttacgtttaatccgtttacgtaccgtttcggggacggtaacgggaacctaaagggttccaagtaacgtaaccgtaaaacgtacgtggtacgggtaccttcggacctaacctacgttccgtgttacccgtttcgaacctttcccgttaccccgacttacgtttaccg

SEQ ID NO: 304367 - DNA, 592 bp, Homo sapiens
  misc_feature: GZ8MTXP02HG1K5.38.6.A06.1.454.CMB.2.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccngggaaacncccctaagctcctgatctatgctcgcctccactttgacaaaggtcggggtacccagtacgaaggttcaggcggacgaggtggatccgtagggactagtatttcactctcaccatcagcagctgcagctagatatttgactaacttatactagtacaatagtactttaaagtatttactcttacgtaacgtttcgggacggtaagggtacccgtaaaggtccgtaagaacgtaacgtaaaaccggtacgttcgggtacgggtacttacggaacctaaacccgttacgttaccgttaacgtttaccttaccgttaccgttccccgttaccccgtacttaacgttacg

SEQ ID NO: 304368 - DNA, 504 bp, Homo sapiens
  misc_feature: GZ8MTXP02GKHYO.38.6.A06.1.454.CMB.2.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (431)..(431): a, c, t, g, unknown or other
  misc_feature (431)..(431): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaancccctaagctcctgatctatgctgcctccactttgacaaagtcggggtcccatacgaaggttcaggcggcagtggatccgtgggacagtactttcacttctcaccatcagcagcctgacagcctgaacgtattttgactaactttatactgtacaactagtacttaaatgttatctactacgttcggnggtaggacctaaggtcagatacgaaacgtactgnggactgcactatctgtcttacncttcctaccnctactcg

SEQ ID NO: 304369 - DNA, 538 bp, Homo sapiens
  misc_feature: GZ8MTXP02F769F.38.6.A06.1.454.CMB.2.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (348)..(348): a, c, t, g, unknown or other
  misc_feature (348)..(348): n is a, c, g, or t
  modified_base (529)..(529): a, c, t, g, unknown or other
  misc_feature (529)..(529): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaacgnggaacnccctaagctcctgatctatgctgcctcatttgacaaggtcggtacccagtcgaaggttcaggtcggacaggtggatccgtagggactagtacttcactctcacntcagcagctgcagtcgtagtaagtatttcgactaactttactacgtagtaccaaatagttaacttaattacgttactcttacgtacggttcgggacggtacggaccgtaaggtcaagtactaacgaaaacgtacgtggtacggctacgctaccgtatctaacgtcttacacttccctaccnctacgtacg

SEQ ID NO: 304370 - DNA, 543 bp, Homo sapiens
  misc_feature: GZ8MTXP02GN992.38.6.A06.1.454.CMB.2.raw
  modified_base (237)..(237): a, c, t, g, unknown or other
  misc_feature (237)..(237): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagcagttattagcctggtatcagacaaaaaccngggaaacgcccctaagctcctgatctatgctgccctccactttgacaaaggtcggggacccagtcaagggttcaggcggcaggtggatcccgtaggggacagtactttcacttctcaccatcagcagcctgcagcctagaagtatttgactaacttattactagacaaacagtacttaaatacgttatctacgtacgtttcgggacggtagggaccaaaggtcgaaagtactacgaaaacggacttggtacgggctacggaccacctacttcgtcgtcttacacttccgttcccgcctaacttccg

SEQ ID NO: 304371 - DNA, 571 bp, Homo sapiens
  misc_feature: GZ8MTXP02I13AY.38.6.A06.1.454.CMB.2.raw
  modified_base (167)..(167): a, c, t, g, unknown or other
  misc_feature (167)..(167): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggccagtcagggcattagcagttattagcctggtatcagacaaaacaggaaacgccctaagctcctgatctatgctgcctccatttgacaaaggtcgggtcccatcaaaggttcaggtcggcagtggatccgtagggactagactttcacttctcaccatcagcagcctgcagcctagaacgttntttnacttaacttattactacgtacaactagtactttaaatagtttatctacgtacgtttcggacggtaacggaccgtaaagggtcgaagtaactaaccgtaaaaacgtaccgttggtacggtactacgaccctaaaccgtacgttcttaacggttacctttacctacttcccctttaaccccgcttaacttaccgg

SEQ ID NO: 304372 - DNA, 575 bp, Homo sapiens
  misc_feature: GZ8MTXP02JWWKL.38.6.A06.1.454.CMB.2.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagccttggtatcagacaaaaccgaggaaacnccctaagctctgatctangctcgcctcctactttgacgtaaggtcgggtacccagtaccgtaaggttcgagcggtcgtaggtggatccggtgggactagtactttcacttctcgacatcagcagcctgcacgcctagagttgtttgactacgttattacgtagtactaacgtagtactttaattagtttacttacctacgttaacgtttacggacgggtaacgggacgtaaggtcgaaagtacgtaaccgaaaacgtacgttcggtcggacctacggacctacctagttccttgttccttactacgttcccgtaccctctacgttaccg

SEQ ID NO: 304373 - DNA, 556 bp, Homo sapiens
  misc_feature: GZ8MTXP02FQ7IY.38.6.A06.1.454.CMB.2.raw
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgaggaaacncccctaagctcctgatctatgctgcctccatttgactaaaggtcgggtacccatcgaaggttcaggcggcaggtggatcgtgggacagtatttcactctcaccatcagcagcctgcagcctagaacttntttagactaactttataactgtacaactagtacttaaatacgttatctacgtacgttcgggacggaggtaccgaaggtcgaagtacgtaacgaaaaacgtcgttggtacggacttacgaccctaaacctacgttacgttcgttaccttaccgtaccttcccgtaccccgtactacgtaccg

SEQ ID NO: 304374 - DNA, 524 bp, Homo sapiens
  misc_feature: GZ8MTXP02GG3IZ.38.6.A06.1.454.CMB.2.raw
  modified_base (312)..(312): a, c, t, g, unknown or other
  misc_feature (312)..(312): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaagcccctaagctcctgatctatgctgcctccactttgacaaagtggggtcccatcaaaggttcagcggnagtggatccgtgggacagatttcactctcaccatcagcagcctgcagcctgaaagtattttgactaaactttattactagtacaaactagtactttaaatagttaactcttcaacgtttcgggacggaacggggaccaaagggtcgaagtaataacaaaacgaacgtagtagtcgtcgacactatctgtcttactactcctcctcctactcg

SEQ ID NO: 304375 - DNA, 591 bp, Homo sapiens
  misc_feature: GZ8MTXP02G64P9.38.6.A06.1.454.CMB.2.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtcaactggatggcacatctggctcctgctgctctggctcccaggtgccagatatgccatccagttgacccagtctccatcctccctgtctgcatctgtaggagacagagtcaccatcacttgccgggccagtcagggcattagctagttattagcctggtatcagaacaaaacgaggaaacnccctaagctcctgatctatgctcgcctcctactttgacgtaaggtcgggtaccagtacgtaaggttcaggcggacaggtgagtcgtaggactagtacttcactctcactatcgagcacgctcgacgcgtacctagtaaggttctttagaacttaacttacgttactacgtacaaacgttagtactttaaattacgtttactaccttacgtacggtttaccgggacggtacggggtaacgtaagggttacgaagtaacgtacgaaaaaccggtcttgggacggttacacggtacctaactcgttctcgttcctacgtaccttcccgtacccgtactaaccgttcgg

SEQ ID NO: 304376 - DNA, 647 bp, Homo sapiens
  misc_feature: GZ8MTXP02IU9JZ.38.6.A06.1.454.CMB.2.raw
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
tcagtcgatcacgtcacgaccggtgctcgatttagatctactgacagggaggatggagactgggtcaactggatggcacatctggctcctgctgctctgactcccaggtgccagatgtgccatccagttgacccagtctccatcctccctgtctgcatctgtaggagacagagtcacatcacttgccgggcagtcagggcattagctagttattagcctggtatcagacaaaaaccagggtaaacncccctaaagctcctgatctangctcgcctccactttgactaaacggtcggggtaccatacgtaaggtttcacgtcggactaggtggactccgtagggactagtacttttacgaccttctcctaaccgtactccgaacgccgaacgtccctagaccgagtcccgtaggtaaactgttttacgaacttaacttacttaacgtgtacaaacgtagtaacctttaaatagtttataccgtacgttaaccggttcggaccgggtaacgggtaaccgtaaaacgggttcggaaacgtaagtaaaccgtaaaacggtaacgttcgggtaacggcttacgtacccaaaccgttaacgtcgttcggtacctttacgtacctcccgttttacccgaccttacgtttaaccg

SEQ ID NO: 304377 - DNA, 678 bp, Homo sapiens
  misc_feature: GZ8MTXP02J2WCK.38.6.A06.1.454.CMB.2.raw
  modified_base (166)..(166): a, c, t, g, unknown or other
  misc_feature (166)..(166): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtccacatcacttggccgggcagtcgagggctagttagctagtttacttacgctaggtatcgaagaacaaaaccgaggggaaacctccctaaagcctacagactacgtatcggacttcgacccttacctagtttcgacgtaaacgggtcggtacccagttaccgaagggttcacggcggtacgaagggttcggaacttccgggtacggggaacctaacggtttacttttaccaaccgttctaccaaacgttacctacgtaacgaccgacggttcccgtacgaccgtaacgtacgtaagtaactttacgtttacgactttaacttacgtactactacaacgttacgttaacttaagttacttctacgttacgttacggtacgggacgggtaacggtaaccgtaggtacgtaacgtaacgtaaacgtaacgtacgtcggtacgtactacgacctacgttcttaccgttaagttaccttaccgtaccttacccgtacccgtactacgtcg

SEQ ID NO: 304378 - DNA, 597 bp, Homo sapiens
  misc_feature: GZ8MTXP02H4DKV.38.6.A06.1.454.CMB.2.raw
  modified_base (244)..(244): a, c, t, g, unknown or other
  misc_feature (244)..(244): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagctggtatcaagacaaaacgagggaacnccctaagctcctgatctatcgctcgtcctcctacgtttgacgtaaaggtcggggtacccctagtccgtaaagggttcgaaggcggacgtaggtggactccgagggacagtactttcacttctcacatcagcacgctagctagctagaagttacttcgtacttaacttacgttacacgttacaaactagttactttaaattgtttactcgtacgtacggtttcggaacgggtacggtaaccgtagggtaccgtaagtaacgtaaacggtaaaacgtaacgttggtaacgtcgtacgacctactattcgttaacgttcttactaccgttccctttacccgactttacgtacccgg

SEQ ID NO: 304379 - DNA, 800 bp, Homo sapiens
  misc_feature: GZ8MTXP02JXX0V.38.6.A06.1.454.CMB.2.raw
  modified_base (166)..(166): a, c, t, g, unknown or other
  misc_feature (166)..(166): n is a, c, g, or t
  modified_base (260)..(260): a, c, t, g, unknown or other
  misc_feature (260)..(260): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtcaccatcacttggccgggcagtcagggcattagctagttattagctggtatcgagacaaaaaccgagggaaacgcccctaagctccngactctatgctcgccctcctacgtttagacgtaaaacggttcggggtaccccaagtaccgtaaagggttccgaacgggccgggtactagggtacgggtagttacccgtagggggtaacctaggttaaccttttaccaaccttccctaccaaccctaacttaccgaaggtacccaacgggtccctaggaccgaacggttacccgttagggtaaaacgttactttttacggaaaccttaaacttttaacgtttacttacggtaaccctaaacggttaaacgtttaccgttttaaaattaacggtttaactttacccttaacggtttaacccgggtttaccggggaaccggggtaacgggggttaaaccctaaaggggttcccgaaaaggtttaaccgtaaaaccgtaaaacgggttaacccgttaggggtaacgggtaccctacgggtaccctaaaacccgtttaacttcccggtttaacgttacccctttaacggtaacccgtttccccccttacccggtaacccttacggtttaacccgg

SEQ ID NO: 304380 - DNA, 586 bp, Homo sapiens
  misc_feature: GZ8MTXP02I4TJZ.38.6.A06.1.454.CMB.2.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaacgagggaaacncccctaagctcctagatctatcgctgcctccactttgactaaaggtcgggtacccagtacaaggttcaggcgcagtggatccgtagggacagtactttcactctcaccatcagcctagcctgactagcctagatagtttcgactaaactttattactgtaacaacgtagtactttaaatgtttactcttacgtacgttcgggacggaagggacctaaaggtcgaagaacttaaccgaaaacggtactttgggacggtaccttaggacccttaaacccgttagttaccgttaacgtttacccttaaccgtaccgttacccgttaccccgacttacgtaccg

SEQ ID NO: 304381 - DNA, 516 bp, Homo sapiens
  misc_feature: GZ8MTXP02GOHSG.38.6.A06.1.454.CMB.2.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (404)..(404): a, c, t, g, unknown or other
  misc_feature (404)..(404): n is a, c, g, or t
  modified_base (483)..(483): a, c, t, g, unknown or other
  misc_feature (483)..(483): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaccngggaaancccctaagctcctgatctatgctgcctcactttgactaaaggtgggtccatcaaggtcagcgnagtggatcgtgggacagattcactctcaccatcagcagcctgcagccagaagtatttgactaacttattactgtacaatagtctttaaatagtttanccttacgtacgttcgggacggtaaggacctaaagggtcgaagtactacgaaaacgagttgtacggctaggaccaacctntcgtcgttctactactccgtaccgactacgtcg

SEQ ID NO: 304382 - DNA, 565 bp, Homo sapiens
  misc_feature: GZ8MTXP02JKCLR.38.6.A06.1.454.CMB.2.raw
  modified_base (245)..(245): a, c, t, g, unknown or other
  misc_feature (245)..(245): n is a, c, g, or t
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcgagggcattagctagttattagctggtatcagacaaaaacgaggaaacnccctaagctcctgatctatcgctcgccttctacgtttagacgtaaaggtcggtaccaattcgtaaagggttcaaggcggacgtaggtcggtatccggtagggactagtacttcacttctcacctatcgancgacgcctgactacgtctagtaagttntttacgacttaaacgttattactgtacaactagtacttaaatatatcgtactacgttacgggacggaggtacgtaggtacgagtaactacgaaaacgtgtacggcgactcgtacctacgtattcgtaagttccttacgaccgttctaccccgtctaacttcgg

SEQ ID NO: 304383 - DNA, 579 bp, Homo sapiens
  misc_feature: GZ8MTXP02IPA79.38.6.A06.1.454.CMB.2.raw
  modified_base (249)..(249): a, c, t, g, unknown or other
  misc_feature (249)..(249): n is a, c, g, or t
  modified_base (383)..(383): a, c, t, g, unknown or other
  misc_feature (383)..(383): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttcgccgggccagtcagggcattagctagttattagcctggtatcagacaaaaaccgagggaaacncccctaagctctgatctatgctcgcctcctactttgacgtaaaggtcgggtaccagtcgtaagggttcaggcggacaggtggtatcgtagggactagtacttcactctcacatcagcagctgcagctagaagtntttgacttaacttattctagacaacagttactttaaatacgtttactccttacgtaaccgtttcgggacgggtaacggtaccgtaaagggtcgtaaagagtaacccgtaaaaggtacgttggcggtacctacggaccctaaccgttattaccgttaacgttccttacctaccttcccgttacccgtactacttacg

SEQ ID NO: 304384 - DNA, 566 bp, Homo sapiens
  misc_feature: GZ8MTXP02IEBGA.38.6.A06.1.454.CMB.2.raw
  modified_base (167)..(167): a, c, t, g, unknown or other
  misc_feature (167)..(167): n is a, c, g, or t
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
  modified_base (492)..(492): a, c, t, g, unknown or other
  misc_feature (492)..(492): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagganacagagtcaccatcacttgccgggcagtcgagggcattagntagttattagctggtatacagaacaaaacgagggaaacncccctaagctcctagatctatcgctcgtcctacctactttagaccgtaaaggttcggggtaccccaagttacgaacgggtttcaagggcggactaagggtggactccgtagggactagtactttcacttcctcacctatccagccacgtcngactgcctagattatttgactaattatnacgtacatacgtactttaaatatttatcttacgttacgttcgggaggtacggaaccgtaagggttnaagtactaacgaaacgtagtggtcgactacgactaactnttacgtnttaccttactccttcctccactacgtcg

SEQ ID NO: 304385 - DNA, 614 bp, Homo sapiens
  misc_feature: GZ8MTXP02H1O7W.38.6.A06.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
tcagtcgatcacgtcacgaccggtgctcgatttagatctactgacagggaggatggagactgggtcaactggatggcacatctggctcctgctgctctggcctcccaggtgccagatgtgccatccagttgacccagtctccatcctccctgtctgcatctgtaggagacagagtcaccatcacttgccggcagtcagggcattagctagttattagctgtatcaagacaaaacgaggaaacnccctaagctctgatctangctcgcctctactttgactaaaggtcggtcccatcgaagttcaggcgcaggtgtatccgtaggactagactttcgactctccgactatccagacctacggccctaggactagaccctaggtaactattttcgaactttaaacttattactagtaccaagtaacgttaactttaaagttacgtttactacccgttacgtaccggtttacgggacgggtaacgggtaacaacgggttccgaaaaggtactaaccgtaaaacggtacgttcggtaacggcttacggaccttaacccgaattcggttaacgttccctttacgaacctttcccggtacccccgtacttaaacgtaccg

SEQ ID NO: 304386 - DNA, 601 bp, Homo sapiens
  misc_feature: GZ8MTXP02G7Q98.38.6.A06.1.454.CMB.2.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (389)..(389): a, c, t, g, unknown or other
  misc_feature (389)..(389): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgngggaaacnccctaagctcctgatctatgctgcctccactttgactaaaggtcgggtacccagtcgaaggttcaggccggactaggtggtatccgtgggacagtacttcactctcacatcagcacgcctagaccgagtacctagaaagttnttttacgacttaacgttacttacgtagtactaaacgtaggttacctttaaagttacgtttataccgttacgtaccggtttacgggacgggtaacgggtaccgaaagggtaccgaagtacgtaaccgtaaaacggtacgttggtacggtactacggacctaaccgtattcgtaacgttaccttactacttcccgttacccgacttacgtaccg

SEQ ID NO: 304387 - DNA, 500 bp, Homo sapiens
  misc_feature: GZ8MTXP02FS6AW.38.6.A06.1.454.CMB.2.raw
  modified_base (167)..(167): a, c, t, g, unknown or other
  misc_feature (167)..(167): n is a, c, g, or t
  modified_base (243)..(243): a, c, t, g, unknown or other
  misc_feature (243)..(243): n is a, c, g, or t
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatccctcctgtctgcatctgtagganacagagtcaccatcacttcggccgggtccagtcagggcattagctagttattagcctggtatcagacaaaaaccgnggaaacgcccctaagctcctgactctatgctgcctacactttgactaaaggtcgggtccagtcgaaacggtcaggcggacgaggtaggatcggtaggacagtacttcactctcacatcagcagcctgcagctagaagttnttgactacttatacgntacatacgtataagtatacnctactgtacggcggtaagaccgaaggtnaagctaacgaactacgtgacgntagcacgtntctntctcactctacncactcg

SEQ ID NO: 304388 - DNA, 612 bp, Homo sapiens
  misc_feature: GZ8MTXP02I3860.38.6.A06.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (354)..(354): a, c, t, g, unknown or other
  misc_feature (354)..(354): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaacngggaaacnccctaagctccngatctatgctcgcctccatttgacgtaaggtcgggtacccagtcaaacggttcagcggcagtggactcgtgggactagtatttcgacctctcaccntacagctagcctgacacgcctagtaaaggtattttcgaactaactttaatttaccgagtacctaacgattaacctttaaattacgttacttaccgtacgttaaacgtttccgggaacgggtaacggggtacctaaacgggtcgtaaacggattaaccgtaaaacgtacggttcgtagggtaccttacggacctaacccgtagttacctcggttaccctttacgtaccttcccggtttacccgaccgttaacttaccgg

SEQ ID NO: 304389 - DNA, 698 bp, Homo sapiens
  misc_feature: GZ8MTXP02IVHD5.38.6.A06.1.454.CMB.2.raw
  modified_base (241)..(241): a, c, t, g, unknown or other
  misc_feature (241)..(241): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagagacagatcaccatcacttgccgggcagtcagggcattagctagttattagcctggtatcagacaaaacgaggaacncccaagctctgactctatgctcgcctccacgtttgacgtaaaggtcgggtcctatcgaaacgggttcaggccgacgaggtggtactccgtggggaactacgttatttccaccgttctccaccctatacccgagccaacggccctaggacccgtacgtacccgttaaggtaaacgttcggtttttaacgaaacctaaacgttttaaactttaacccgtgtaaaccctaaaggttaacttaacgtttaaaccttaggtttacttacccttacccgggttaaacggtttaccggggaaaccggggtaacggggaaccgtaaacggggttaccgaaaggtaactaaaaccgggtaaaaacgtcggtaggtccggtactaccggtacccgtaaacctctttaaccgtcgtttacccgttaccttaccttaccccggtttcccccgatttaaccgttaccggg

SEQ ID NO: 304390 - DNA, 695 bp, Homo sapiens
  misc_feature: GZ8MTXP02FHINO.38.6.A06.1.454.CMB.2.raw
  modified_base (267)..(267): a, c, t, g, unknown or other
  misc_feature (267)..(267): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacgttgccgggccagtcagggcattagctagttattagcctggtatcgagaaaccaaacggaggaaccacctagcctctagtactntagcgctcgccctacttagtcgaacggtagggtccggacctatacggtagtacgacgggcgagtggtacggtagtccggtacggtaactagttacttacacctactacccacactacgacgtaccgacgtccgtacgacaccggttacttaaagggtaacttttaacgttccgtaaaacctttaaactttaacgtttacccagtaaaaccaaacggttagtttaaaccttaaaatttcgttaaaccttccccggtaaacgggtttccggttaccgggggaaacggggtaaccctaaacggggttaaggaaccgtaaagtaccctaaaaaccgaaacggtcggtttcggggccttacggacgtaaccccattccgttcgtaaccgtttactaccctacccgtttccccggcctaatcccggtttaaacg

SEQ ID NO: 304391 - DNA, 598 bp, Homo sapiens
  misc_feature: GZ8MTXP02IE4U7.38.6.A06.1.454.CMB.2.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaacngggaacnccctaagctcctgatctatgctcgcctccagttttgacgaaaggtcggggtacccaagtacgtaagggttcgaggccggacaggttggacttccgaggggacacgtatttccacttctcacctatcgagcagcctgcagcctagagttatttgactaactttattacgtagtaccaaatagttactttaaagtacgtttaacttccttacgttacggtttccgggacgggtaacgggaccgtaagggttcgaagtaacgtaacgaaaacgttaacgtggtcggtaccttcggacccacttacgtcttaacggttcctttacaccggtttccctttacccccgacgtacgttcg

SEQ ID NO: 304392 - DNA, 572 bp, Homo sapiens
  misc_feature: GZ8MTXP02FGVVR.38.6.A06.1.454.CMB.2.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (366)..(366): a, c, t, g, unknown or other
  misc_feature (366)..(366): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccggaccagtcagggcattagcagttattagcctggtatcagacaaaaaccngggaaancccctaaagctcctgatctatgctgcctccactttgacaaagtgggtcccatcaaggtcagcgcagtggatcctgggacagatttcactctcaccatcagcagcctgcagcctagaacgtntttgactaaactttataacctgtaccaaacagtacttaaatagttaactcttaccgtaacgtttccggggacggaacgggtaacccgtaaagggtccgaaggtaactaacgaaaaacgaaccgtggttacgggcttacgacccgtaaccaacgtttccgtgttccttaaccactttcccctttaccccggacctaacgtttacccg

SEQ ID NO: 304393 - DNA, 493 bp, Homo sapiens
  misc_feature: GZ8MTXP02FFI0X.38.6.A06.1.454.CMB.2.raw
  modified_base (239)..(239): a, c, t, g, unknown or other
  misc_feature (239)..(239): n is a, c, g, or t
tcagtcgatcacgtcacgaccggtgctcgatttagatctactgacaggggagggatggagactgggtcaactggatggcacatctggctcctgctgctctggctcccaggtgccagatgtgccatccagttgacccagtctccatcctccctgtctgcatctgtagagacagagtcaccatcacttgccgggccagtcagggcattagcagttattagcctggtatcagcaaaaaaccngggaaagcccctaagctcctgatctatgctgcctcactttgcaaagtggggtcccatcaaggttcagcggcagtggatctggggacagattttcactctcaccatcagcagcctgcagccctgaatattttgcaaattattaactgtcaacagcttaaatgttaatctcactttcggcggaggggaccaagggtcgagatacaaaacggaactggtaggctgccaccagtctgtcttcactcttcccgccatcg

SEQ ID NO: 304394 - DNA, 574 bp, Homo sapiens
  misc_feature: GZ8MTXP02JMUX6.38.6.A06.1.454.CMB.2.raw
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
  modified_base (529)..(529): a, c, t, g, unknown or other
  misc_feature (529)..(529): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcactgccgggcagtcagggcattagctagtttattagcctaggtatcaagacaaaaacgngggaaacgcccctaagctccngatctatgctcgcctcnctttgactaaggtcggtcccagtacaaggttcagcgcagtgatccgtggacngtattcacttcncaccatcagcagcctgacacgtctaggaaactntttttagacctaaactttactaacgtcgtactaaacgtatacctttaaaatacgtttatccgttacgtacgtttacgggcggtaacggtaacccgaaggttccggaataacgttacgaaaacgtacgttggccggtaatcggacccaaacgttntccgtaagttccttaccgtacttcctaacccgtctaagttcccgg

SEQ ID NO: 304395 - DNA, 622 bp, Homo sapiens
  misc_feature: GZ8MTXP02FXSKO.38.6.A06.1.454.CMB.2.raw
  modified_base (167)..(167): a, c, t, g, unknown or other
  misc_feature (167)..(167): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatccctcctgtctgcatctgtagganacagagtcacatcacttgccggcagtcagggcattagctaagtttatttacgccttaggtatacaagaaccaaaaaaccgaggggaaacgacccctaaagctcctagatctatcgctgcctactactttgacgaaaggtcggggtacctagtacgtaagggttcacgggcgacgaggtaggactacccggtaggacgtagtactttacaccttcctacacctatacgacgacacgtcctcgacgacgtccgtaagtaattattttacgaacttaaactttattactagtacaacgtattacttaaatatttactcttacgtacgttacggacggtaaggaccgtaaaggtcaaaggtaactaacgaacgtaacggtgtacggacgtacgactaaacctcgttacggtaactttccgttactaaccgttcccgtacccgtacctacgtttaaccgg

SEQ ID NO: 304396 - DNA, 534 bp, Homo sapiens
  misc_feature: GZ8MTXP02I59ZH.38.6.A06.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (485)..(485): a, c, t, g, unknown or other
  misc_feature (485)..(485): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtagagacagagtcaccatcacttgccgggccagtcagggcattagcagttattagcctggtatcagcaaaaaccngggaaagccctaagctccngatctatgctgcctccatttgcaaagtgggtccagtcaaggttcagcggactagnggtactccgtagggacagtactttcactctcgaccntcagcagcctgacagtcctagaaagtntttagactaacttattaccgtgtacaacgtagtacttaaatcgttattacctcgttacgtttcggacggtagggacctaggcgaacgatacgaaaacgtcgtggtacggtcnctactacgtcttacggtcgtctttaccgtcttccgtaccactacgtacg

SEQ ID NO: 304397 - DNA, 556 bp, Homo sapiens
  misc_feature: GZ8MTXP02JGLLG.38.6.A06.1.454.CMB.2.raw
  modified_base (247)..(247): a, c, t, g, unknown or other
  misc_feature (247)..(247): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgagggaaacnccctaagctcctgatctatcgctgcctcactttgacgaaaggtcgggtaccatcgaaggttcaggcggcgagtggatcgtaggacagtacttcacttcncacatcgancacgctgacagcctagaagtntttagacttaacttattctagtacaaactagtactttaaatacgtttactccttacgtacgtttcggggacggtaacggtaccgaaggtacgaagactaaacgaacgtacgtgacggtctacgacctaacctcgttactgttaccttactaccttcccgtacccgtacctacgtttaccg

SEQ ID NO: 304398 - DNA, 566 bp, Homo sapiens
  misc_feature: GZ8MTXP02IJ82A.38.6.A06.1.454.CMB.2.raw
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcaccatcacttgccgggcagtcagggcattagctagttattagcctggtatcaagacaaaaacgagggaaacncccctaagctcctgatctatgactgcctccactttgacaaaggtcggtcccatcgaaaggttcaggcgacaggtggatcgtagggacagtactttcacttctcaccatacgacgcacgccctagccagtccctaagtaagtatttcgacttaaacttacttacgtagtacaacgagttaccttaaagttacgtttactacgttcgtaacgtttcgggacgggtaacggtaaccgtaggtacgaagtaactacgaaaacgtacgttgacgtcgtacgtacgaacctctacgtcgttactcacttcctcctacacttacgg

SEQ ID NO: 304399 - DNA, 605 bp, Homo sapiens
  misc_feature: GZ8MTXP02IJQQ4.38.6.A06.1.454.CMB.2.raw
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtaggagacagagtcaccatcacttgccgggcagtcagggcattagctagttattagctggtatcagacaaaacgagggaaacnccctaagctcctgatctatgactgcctcacgtttgactaaaggtcgggtaccagtcgtaaaggttcagcgcaggtgatccgaggactagtattcacttctcgactagtcagcacgcctgactacgcctaggaaattcgttttacgacttaaacgtttactaactgtaacaatagttactttaaatacgtttactcttacgtacgttcgggaacggtaggaaccgtaggtacgaagtaactaaccgtaaaacgtaacgttcggtacgtaccgttaacgacccgtaaaccgttacttaccggttaacgtttcccttaacggttacctttacccgttacccccggtactttaacgtttaacccgg

SEQ ID NO: 304400 - DNA, 552 bp, Homo sapiens
  misc_feature: GZ8MTXP02IP2NW.38.6.A06.1.454.CMB.2.raw
  modified_base (166)..(166): a, c, t, g, unknown or other
  misc_feature (166)..(166): n is a, c, g, or t
  modified_base (244)..(244): a, c, t, g, unknown or other
  misc_feature (244)..(244): n is a, c, g, or t
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctcctgtctgcatctgtagganacagagtcaccatcacttgccgggcagtcagggcattagctagttattagctggtatcaagacaaaacgagggaaacnccctaagctctagatctatgctcgcctctacgtttgacgtaaggtcgggtacccagtacgtaaggttcgacgtcggactaggtggatccgtagggactagtactttcacttctcactagtcacgcacgcctgacagctagtatntttgacttattagtacagtacaagtattactttaaatagtttanacttcgtaacgttcgggaacggttaacggaccgtaaggtccgaagaacgttaacgaaacgtagtgtcgaacggtcaccgtactatcgttaactcttactacctcctacctctacttacgg

SEQ ID NO: 304401 - DNA, 622 bp, Homo sapiens
  misc_feature: GZ8MTXP02IMNB6.38.6.A06.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (364)..(364): a, c, t, g, unknown or other
  misc_feature (364)..(364): n is a, c, g, or t
tcagtcgatcacgtcacgaccggtgctcgatttagatctactgacagggaggatggagactgggtcaactggatggcacatctggctcctgctgctctggctcccaggtgccagatgtgccatccagttgacccagtctccatcctccctgtctgcatctgtaggagacagagtcacatcacttgccgggccagtcagggcattagctagttattagctggtancagacaaaacgaggaacncccaagctctgatctatnctcgtcctctactttggacaaagggtcgggtacccagtacgtaagggttcagcgggtcaggtggatcgtgggactagtactttcacttctcactactcagccanccgtagactacgaccgtaggtaacttattttcgaaacccttaatttacttaacgtacgttacaaaactacgtttaaactttaaagtttaacgtttaattaccgtttaccggttaaacgtttccgggggaacggaaacggggttaaacccaaaggggtttaacgaacgtacgttaaaacgaaaccgtaacgtggtcgccgtacgtaaccaccttacgttactcgtacttaccgttactcccgtttaccctactacgtcg

SEQ ID NO: 304402 - DNA, 543 bp, Homo sapiens
  misc_feature: GZ8MTXP01BM81O.17.42.D09.1.454.CMB.2.raw
  modified_base (520)..(520): a, c, t, g, unknown or other
  misc_feature (520)..(520): n is a, c, g, or t
  modified_base (534)..(534): a, c, t, g, unknown or other
  misc_feature (534)..(534): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtgctccagcactggagctgtcaccaatggtcattatccctactggtaccaacagaagcctggccaacgcccccaggaccactgatttatgaatacaaacaacaaacactcctcgaccctcgcccgtctcacgcctccctcggttacggggcaagctcgccctcgtacccgttcgggtcgcgcagcctgacggagtgaggctgagtattactgtcttgctcgtcctagtgtggtgttgggtgttcgggcggtaggaccagctgaccgttcgtagttcgacgccaggcttcgcccctcggtcncgtcttcgtccccncccgttccc

SEQ ID NO: 304403 - DNA, 533 bp, Homo sapiens
  misc_feature: GZ8MTXP01AT18G.17.42.D09.1.454.CMB.2.raw
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
tcagcgtagactagcacgaccggtgctcgatttagacacatacgcagggaaaggggcccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaatgtcattatccctatggtccaacagaagcctggccaagcccccaggacactgattatgatacaaacaacaaacactcctacggacccctgcccggttctcaggctccctcgttggggcaagctgccctcgaccctttcgggntcgcagcctgacggatgaggctgagtattacngtctgctctccttagtacgtggtgttcgggtgttcgggcgggtagggaccgtaagcgtggaccgttcgtaggttcgagcccaggcttcgcccctggcnctcncgtccnccttccg

SEQ ID NO: 304404 - DNA, 654 bp, Homo sapiens
  misc_feature: GZ8MTXP01DSJQJ.17.42.D09.1.454.CMB.2.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattatccctactggtccaacagaacgcctggcccaacgcccccaggacactgacttanagaataacaaacaacaaacacctacctacggacccctgccccgttccncagcctccgtcggtaggggacaagctacgccctcgtacccgttcggggcgtccgcgagcccgtaggaggatggaggtctaggtacgttacttacgtcgtcgttcggtccttcttccgttaagttacgggttgggtttgggtttccggggttggtttccggggacgggtacgggaccgaacggtcgtaacggtcccggttcgtacgggttccgaacggtacccaacgggccgttacccgcccccgttacggttccctaccgttcccgttccgttcccccgttaaccccgtttccccg

SEQ ID NO: 304405 - DNA, 556 bp, Homo sapiens
  misc_feature: GZ8MTXP01EIJCB.17.42.D09.1.454.CMB.2.raw
  modified_base (309)..(309): a, c, t, g, unknown or other
  misc_feature (309)..(309): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (518)..(518): a, c, t, g, unknown or other
  misc_feature (518)..(518): n is a, c, g, or t
  modified_base (547)..(547): a, c, t, g, unknown or other
  misc_feature (547)..(547): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcactggagctgtcaccaatggtcattatccctactggtccaaacagaagcctggccaacgcccccaggacactgatttangaataacaaacaacaaacactacctcggacccctgcccgttcctcgacgcctcccgtcggttacgggggacaaggcctacgcccctcggtaccccgtttcggggcgccgcacgcctggagatgacggntagagtattactgcttgcttctctagtgtggtgtcgggtgtcggngtaggaccagcnggccgttnagttcgcgccaggccncgtcccctggtcctcctcgttcctccccncccgttccc

SEQ ID NO: 304406 - DNA, 684 bp, Homo sapiens
  misc_feature: GZ8MTXP01EM4ZG.17.42.D09.1.454.CMB.2.raw
  modified_base (305)..(305): a, c, t, g, unknown or other
  misc_feature (305)..(305): n is a, c, g, or t
  modified_base (435)..(435): a, c, t, g, unknown or other
  misc_feature (435)..(435): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtgctccagcactggagctgtcaccaatgcattactccctactgtccaacagaagcctggccaacgcccccaggacactgatttanagaataacaaaacaaacaaacactacctacggacccctcgcccggttcctccgaggtcctcccgtcggttaacgggggaccaagctacgcccctcgtaccccgtttcggggcgtcgcgagcctggacggngtgaggcgttagagtacttactggtcttcgcgttcttccgttagtacggttgggttcggttcggggttggtttccgggacggggtacgggaccgtaaggtccgtaacgggtacccgttaccggtacgggttaccgaaccgggtaccccgttaaacggggttcccttcccgggtcccccccgttccgggtaaccccttcccggttcccgtttccccggtttcccccccggttcccccgttttaacccccg

SEQ ID NO: 304407 - DNA, 782 bp, Homo sapiens
  misc_feature: GZ8MTXP01BM95D.17.42.D09.1.454.CMB.2.raw
  modified_base (276)..(276): a, c, t, g, unknown or other
  misc_feature (276)..(276): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtgctccagcactggagctgtcaccaatggtcattactccctactcggtacccaaanagaacgcctggacccaacgcccccaggacactgtatttatagaataacaaaacaaaccaaaacgacctacccgtacggtaaccccctcggtacccccggttcctaccggacggtcccttaccccggtccgggttaacggggggaacccaacggtccgtccggtacccccgttacggtacccccggttttcggggcgccgcccgtaggcccgtagggaacggtagtagggacgggtaccttaggtaacggttacttaccgtggtctttcggcgttaccgttccgttaaagttcgggttgggtttcggggtttcgggggttacgggtttcccgggggacggtaaaccgggggtacccgaaggtcccgtaacgggtaacccggttcccggtaaacgggttcccgaaaccgggtaccccgaacgggttccccgttcccggttcccccccggttcgggttccctccccgtttccggttccccggttcccccccgttaacccgtttcccccg

SEQ ID NO: 304408 - DNA, 599 bp, Homo sapiens
  misc_feature: GZ8MTXP01AET3A.17.42.D09.1.454.CMB.2.raw
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (395)..(395): a, c, t, g, unknown or other
  misc_feature (395)..(395): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaatgtcattactccctatggtccaacagaagcctggccaacgccccaggacactgatttangaataacaaacaacaaacactcctacggacccctgcccgttcncacggcctcctcggtggggcaagctcgccctcgtaccgttcgggtcncgtcacgccgtggacggagtgaggctggtagttattactggtcttgcttcgtccttagtacggttggttcggttcgggtggtttccggggcgggtacgggacgaacggtccgtcggaccgttccgtacggttacgaccggcccgaacggccgttccgtcccccgtggtcctccgtccgttcccgtcccgttaaccccttccccg

SEQ ID NO: 304409 - DNA, 588 bp, Homo sapiens
  misc_feature: GZ8MTXP01AEZYT.17.42.D09.1.454.CMB.2.raw
  modified_base (181)..(181): a, c, t, g, unknown or other
  misc_feature (181)..(181): n is a, c, g, or t
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctnactgactgtgtccccaggaggacagtcactctcacctgtgctccagcactggagctgtcaccaatggtcattatccctactggtccaacagaagcctggccaacgcccccaggacactgatttangatacaaacaacaaacactccncgacccctgcccgttctcagcctcccgtcggttcggggacaagctacgccctcgtacccgtttcgggtcgcgccagccgtggacggagtgaggctagagttattacgtgtcttgcttcgttccttagtacgggttggttggttcgggtggtttcgggcggtagggacctaagcgtcgccgttcgtacggttcgacgtcccgagttccttccggtccccctcggtcctacctccgttcgttcccccgaacccgtttccccg

SEQ ID NO: 304410 - DNA, 705 bp, Homo sapiens
  misc_feature: GZ8MTXP01DSGTN.17.42.D09.1.454.CMB.2.raw
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
  modified_base (375)..(375): a, c, t, g, unknown or other
  misc_feature (375)..(375): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctccagcactgganctgtcaccaatggtctattactccctactcggtaccaaacagaacgcctcggacccaaacggcccccaaggaccactgtatttanagaataacaaaacaacaaaccacctaccgtaccgacccctcggccccgttccnccgacggtcctcccgtcggttacggggacaacggctcgccccgttcgtaccccgtttggggacgccgcgtacgccgtaggaggacgtggacggtcgttaggtagttagttacgtgtcgtttcgccgtttcttccgttagttacgggttgggttcggtttcggggttggttaccgggggcggggtaacgggtaccgtaacggtccgttaacggtacccggttaccggtaacggttcccgaaccggtacccgttaacgggcccttccccggtcccccgttacgggtccctacccgttcccgttacccgttccccccgttccccgtttccccg

SEQ ID NO: 304411 - DNA, 671 bp, Homo sapiens
  misc_feature: GZ8MTXP01BWRII.17.42.D09.1.454.CMB.2.raw
  modified_base (369)..(369): a, c, t, g, unknown or other
  misc_feature (369)..(369): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtcccaggaggacagtcactctcacctgtgctccagcacgtggagctgtcaccaatgtctattactccctactcggtaccaaacacgaacgacctacgaccaaccgaccccaggacctactagtattatagaataaacaaacaaacaaacacctacctaccgaccctcgcccgttccncgacgcctcccgtcggtaacggggacaagctacgccctacgtaccgtttcgggacgtcgcgacgtccgtaggacggtagtcggaaggtcttaggtaacgttacttacgtcgtcgttcgtcgttctaccgttaagttcgggttgggttcgggtttcggggttacggttccgggggtacgggtaacgggtaccgtaacggtccgtaaccggtacccggttacgtacggttccgacgggaccgaacggttccgttcccgtaaccccgtcgtaacctcgtccgttccgtccccgttccctttcccg

SEQ ID NO: 304412 - DNA, 742 bp, Homo sapiens
  misc_feature: GZ8MTXP01CE0SE.17.42.D09.1.454.CMB.2.raw
  modified_base (181)..(181): a, c, t, g, unknown or other
  misc_feature (181)..(181): n is a, c, g, or t
  modified_base (268)..(268): a, c, t, g, unknown or other
  misc_feature (268)..(268): n is a, c, g, or t
tcagcgtagactagcacgaccggtgctcgatttagacacatacgcagggaaaggggccccagctctggcaccaggggtcccttccaatatcagcaccatggcctggactcctctctttctgttcctcctcacttgctgcccagggtccaattcccaggctgtggtgactcaggacgccctnactgactgtgtcccaggaggacagtcactctcacctgtgctccagcactggagctgtcacaatgtcattactcctactcgtaccaanagaacgcctggacccaacgcccccaggacacgtagtatttaagtacaaactaacaaaaccaaaacaaaacctaaccgtacccgttacggaaccccccgttcggtacccccggtttaccctaccggacggtaccttaccccggtcggttaacgggggaccaaacggtccgtaccgtccccgttaccggtaccccgtttcggggtacgccgctaacggtcccgtaggaacggtaagttcggaaaggtccgtagtaacggttattaccgtgtaccgttgccgttcttaccgttagttagggttggttcgggttcgggtgggtttcggggaccgggtaacggtacccgaaggtcggtaaccgtaccggttaccggtaaacgggccaaaccggtaccccgaaacgggttcccttcccggccccccgttcggtaaccctccgttcccgttccggtttccccccccgttcccgttaacccg

SEQ ID NO: 304413 - DNA, 757 bp, Homo sapiens
  misc_feature: GZ8MTXP01CTPKF.17.42.D09.1.454.CMB.2.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
tcagcgtagactagcacgaccggtgctcgatttagacacatacgcagggaaagggggcccagctctggcaccaggggtcccttccaatatcagcaccatggcctggactcctctctttctgttcctcctcacttgctgcccagggtccaattcccaggctgtggtgactcaggagccctcactgactgtcgtccccagggaggacagtcactctcacctgtggctccagcacgtggagctgtacaccaatggtcattactccctactggtaccaanagaacgcctggccaacgccccaggacactagattangaataacaaacaaacaaacacctacacgaccctcgcccggtcctcgacggcctcccgtcggttaacgggggacaagcctcgtaccccgtcggtacccgtttcggggcnccggctacgccgtagggacggtagtagggaggtccgttagtaagttacgttaacgttcgggtaccttcgggttccgtttaacccttaccgtttaggttaaccggggtttggggttccggggtttcgggggtttaggtttaccccgggggtcgggggtaaaccggggtaacccggtaaacgggtccgttaaccgggtaaccccggttacgggttacgggttcccgtaaaccggccccggttaacgggccccgttaccccgggtccccccgttaccgggttccccttacccggtttcccccggtttacccccgtaacccccgttttcccccttccccgg

SEQ ID NO: 304414 - DNA, 606 bp, Homo sapiens
  misc_feature: GZ8MTXP01B9IJU.17.42.D09.1.454.CMB.2.raw
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (508)..(508): a, c, t, g, unknown or other
  misc_feature (508)..(508): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcacgtggagctgtcacctaatgtctattactccctactggtaccaaacacgaacgcctcggaccaacgcccccaggacactgtattanagaanaacaaacaaacaaacactccncgaccctcgcccgttccncacgctcccgtcggtggggacaagctacgcccgtcgtaccgttcgggtcgcgccngccgtggaggngtggagtcgtagtagttattacgtgtcttcgtcttcgtaccgttagttacggttgggttggttcggggttgttccggggnggtaaccgggacctaggtctaacggccgttcgtacggcgacgccgacggttccttccggcccctcggtcctccgtcttccgtccccgttccctttccc

SEQ ID NO: 304415 - DNA, 682 bp, Homo sapiens
  misc_feature: GZ8MTXP01D1RIC.17.42.D09.1.454.CMB.2.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctccagcactgganctgtcaccaatggtcattactccctactggtaccaacagaacgcctggacccaacgcccccaggacactgtatttanagaataacaaacaacaaacactaccgtacgacccctgccccggttccncgacggtccctcccgtcggttacggggacaacggctacgccctcgtacccgtttcgggcgccgcacgccgtaggaggtacgtaggacggtctaggtacgttacgttacgtgtcgttcggtccttcgttaccgttagttagggttcggggtttcgggtttccggggttggtttaccgggggacgggtaacggggtaaccgtaacgggtcccgtcggtacccggttcgttacgggttccgaacggtaccccgaacggttccttcccggtcccccgttcgggtcctacccgttccgttcccgttcccccgttcccgttccccg

SEQ ID NO: 304416 - DNA, 748 bp, Homo sapiens
  misc_feature: GZ8MTXP01CIOD5.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccgaggaggacagtcactctcacctgtcggctccagcacgtggagctgtcacaatgtctattactccctactcgtaccaacgagaacgcctacggaccaacgcccccgaggacctactgtattagtagaataaccaaaacaaaccaaacgtacctacccgtaccgaaccccgtcggtccccgttaccctccgtacggtcccgttcccgtcgggttacgggggacaacggtcctacggtccccgttcggtacccccgtttcggggcgtccgaccgtacggtcccgtagggaacgggtcgttacggggaagccgttaagtaacggttaacttacgttcggtctttccggtcctttacgttacccgttaaggtttcgggttgggtttccgggtttaccgggggttcggtttaccgggggacgggtacgggacccgtaaggtccgtaacgggtcccgttacggtacggttaccgaccggtaccgacggttccgttcccggtcccccgttacgggtcctacccgttcccgttcccggttccccgttcccgtttccccg

SEQ ID NO: 304417 - DNA, 807 bp, Homo sapiens
  misc_feature: GZ8MTXP01CMDEK.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaatggtcattactccctactggtaccaacagaacgcctggaccaacgcccccaggacactgtatttatagaactaacaaaacaaacaaaccacctaccgtacggacccctcgtaccccggttcctaccgacggtccctcccgtcggttacgggggacctaacgtcctttcccgtcggtaccccgtttcggggcgtccgccgacgtcccgtaggacgggtacgtgggacgggtccgttagggtaacgtttacgtttaaccgtcgttaccgtttcggtaccctttccggtttacccgtttaaacggtttaggggtttcgggggtttcggggttttccgggggttcgggggtttaccgggggtacccgggggtaacggggtaacccgtaaacgggtcccggttacgggtaaccccgggtttaccggttaacggggttacccgaccgggaccccgtaacggggttccccgttcccgggttacccccccggtttccgggtaccccgttccccgtttccccggtttccccggtttaccccccggtcccccgtttcccccgtttccccgg

SEQ ID NO: 304418 - DNA, 621 bp, Homo sapiens
  misc_feature: GZ8MTXP01BL0V1.17.42.D09.1.454.CMB.2.raw
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (611)..(611): a, c, t, g, unknown or other
  misc_feature (611)..(611): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggacgccctcactgactgtcgtccccgaggaggacagtcactctcacctgtgctcagcacgtggagctgtcaccaatgtacattactccctactcggtaccaacgagaacgcctcggacccaaccgcccccaggaccactgtatttanagaactaacaaaacaacaaactacctccgtacgacccctcgtcccgttccncgacgtcctcccgtcggtacgggacaacgcctcgtcccgtcgtacccgttcgggcgcgcacgcgtagacggngtggacgtntagtattagttntcgtcttcgtcttcttcgtagtggttggttcggtcgggttggtcgggcgggtacggacgtagtccgtaacggtaccgttcgtacggttccgacggacccgacggccttcccggtcccctcggtccctaccgtccttcccgttccccnccctttcccg

SEQ ID NO: 304419 - DNA, 693 bp, Homo sapiens
  misc_feature: GZ8MTXP01AN3UF.17.42.D09.1.454.CMB.2.raw
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccgaggaggacagtcactctcacctgtgctccagcactgagctgcaccaatgtcattactccctatcggtccaanagaacgcctggccaacgccccaggacactgatttanagaataacaaacaacaaactactacctcgacccctgcccgttcncgacgtcctcccgtggtacggggacaagtcgtacgcccgtcgtacccgtttgggcncgctacgccgtaggaggngtaggacggtactagtaacgttacgttaccgtgtaccgttcggtccgttacgttaccggttaagttacggggtttcggtttcgggtttccgggggttagggtttacccggggacggggtaaccggggaaccttaacgggccgttaaccggtaacccgttacggttacggcccgtaacggacccgttaaccggggttcccttccccgggtcccccgttcgggtcctaccccggtttccttccccgggttaaccccgttccccgttccccg

SEQ ID NO: 304420 - DNA, 709 bp, Homo sapiens
  misc_feature: GZ8MTXP01DXOC4.17.42.D09.1.454.CMB.2.raw
  modified_base (238)..(238): a, c, t, g, unknown or other
  misc_feature (238)..(238): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccaggtccaattcccaggctgtggtgactcaggacgccctcactgactgtcgtccccgagggagggacagtcactctcacctgtgctcagcactgganctgtcaccaatgtctattactccctacgtcggtaccaagagacgcctcggaccaaccgccccaggactacgtagtatttacagaactaacaaacaaacgaaacncctaccgtaccggaccctcgcccggtttcncgacggtccctcccggtgggttaacgggactaacggctcccgccctccgtaccccgtcgggttcgggacnccgtacgacggtcgtggaaggngtacgggagtctaggtagttacgttcgtgttccgttggtcctttcgtaccgtttagttacgggttcggggttcgggtttcggggttcgggttaccggggacgggttaacgggaccgtaaggtccgtaaccgggttaccgttccgggttaaggtcccacgggttaccccggttacggttccccgtaaccgggtcccccgttcgggttccctacccgggtttccttccccggttcccccgttccccg

SEQ ID NO: 304421 - DNA, 529 bp, Homo sapiens
  misc_feature: GZ8MTXP02G1JJJ.17.42.D09.1.454.CMB.2.raw
  modified_base (414)..(414): a, c, t, g, unknown or other
  misc_feature (414)..(414): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctgacccctgccgtcctcagctcctcgttggggcagctgccctgacccttcggtgcgcagcctgaggatgaggctgagtattactgnttgctctcctattagtggtgttcgggtgttcggcggtagggaccgaagctcgaccgtctaggtcacgcccgaaggctcggcccccgtcggtccactctcgttccccacctttccc

SEQ ID NO: 304422 - DNA, 803 bp, Homo sapiens
  misc_feature: GZ8MTXP02GJW32.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggcccaagcccccaggacactgattatgatacaaaacaacaaacactacctacgacccctacgcccggttccctcacggctaccccgtcggttcgggggacaacggcctacgccccgtcgtacccccgtttcggggtcgccggccgaacgcccgttaggaacgggagttagggaacggccgttaggaacggttaattaaccgtgggttacctttcggtacctttcccggttacccttaagtttaacggggttggggtttcgggttttcccggggggtttagggttttcccgggggtaccgggggtaacgggggtaaaccccggaaaacgggtcccgttacggggtaacccccgggtttacccggttaaacgggggtttacccgtaaaccgggtacccccggtaaaaacgggggcccccgttacccgggtaaccccccccgtttcccgggggttaccccttaacccccggtttacccggtttacccgggtttccccccccgtaacccccgtttttcccccccg

SEQ ID NO: 304423 - DNA, 548 bp, Homo sapiens
  misc_feature: GZ8MTXP02J3SJM.17.42.D09.1.454.CMB.2.raw
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
tcagcgtagactagcacgaccggtgctcgatttagacacatacgcagggaaaggggccccagctctggcaccaggggtcccttccaatatcagcaccatggcctggactcctctctttctgttcctcctcacttgctgcccagggtccaattcccaggctgtggtgactcaggagccctcactgactgtgtcccaggaggacagtcactctcacctgtggctccagcactggagctgtcaccaatggtcattatccctactcggttccaacagaagcctggcccaacgcccccaggacactgatttangaataacaaacaacaaacactccncgacccctgccgtcncngctccgtgtggggcagctcgccctgacccgttcgggtgccgcacgccgtgaggagtgagggtctagagtacttactgcttgctctctagtaggtggttgtcgggttgtcggcggacggacaagctcgaccgtcacggtcacgcccgaacggcctccgcccccgttcggcctacctccgtccgttaccccacccttcccg

SEQ ID NO: 304424 - DNA, 525 bp, Homo sapiens
  misc_feature: GZ8MTXP02F34PC.17.42.D09.1.454.CMB.2.raw
  modified_base (309)..(309): a, c, t, g, unknown or other
  misc_feature (309)..(309): n is a, c, g, or t
  modified_base (418)..(418): a, c, t, g, unknown or other
  misc_feature (418)..(418): n is a, c, g, or t
  modified_base (493)..(493): a, c, t, g, unknown or other
  misc_feature (493)..(493): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaaacaacaaacactcctgacccctgcccgtcctcacgctcctcgtcggggcagctcgccctgacccttcgggtgcgcagcctgaggatgaggctgagtatacngtctgctctcctatagtggtgttgggtgttcggcggtaggacgagcgtcgaccgtctacggtcacgccaacggcncgccccgtcggtcactcgtcgtcccgcctccc

SEQ ID NO: 304425 - DNA, 546 bp, Homo sapiens
  misc_feature: GZ8MTXP02GK35T.17.42.D09.1.454.CMB.2.raw
  modified_base (529)..(529): a, c, t, g, unknown or other
  misc_feature (529)..(529): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcctactggttccaacagaagcctggccaagcccccaggacactgattatgatacaaaacaacaaacactcctagacccctgcccggttcctcacggtcctccctcggttcgggggacaaggcctcgcccctcgtaccccgtttcggggtcgccgcgacgccctggacggatgaggctgagttatactgcttgctctctatagtggtgttgggtgttcggcggaggaccagctcgaccgtctaggtcacgcccaagcctcgccccgtcggtcnctctcgtcccgcctacc

SEQ ID NO: 304426 - DNA, 664 bp, Homo sapiens
  misc_feature: GZ8MTXP02H5OG2.17.42.D09.1.454.CMB.2.raw
  modified_base (315)..(315): a, c, t, g, unknown or other
  misc_feature (315)..(315): n is a, c, g, or t
tcagcgtagactagcacgaccggtgctcgatttagacacatacgcagggaaaggggccccagctctggcaccaggggtcccttccaatatcagcaccatggcctggactcctctctttctgttcctcctcacttgctgcccagggtccaattcccaggctgtggtgactcaggagccctcactgactgtgtcccaggaggacagtcactctcacctgtggctccagcactggagctgtcaccaatggtcattactccctactcggttaccaacagaacgcctggacccaacgccccccgaggaccactgatttanagaataacaaaacaaacaaaacactacctacggacccctcgcccggttcctcgacgcctcccgtcggttcggggacacgcctacgccctcgtacccctttcggggtcgccgccagcccgtgaggacgtggaggcgtagaagttacttacgtgtcttgccttcgttacctagttagggtggtttgggtttccggggttcggttacggggtcggggaacggaccgaaacggtccgtcggacccgttccggtaaacggtccgaaccggaccccgaaacgggtcctcccggccccccgtttcggacccttaccgttcccgtttacccggttcccccctaacccctttcccccg

SEQ ID NO: 304427 - DNA, 548 bp, Homo sapiens
  misc_feature: GZ8MTXP02GNF44.17.42.D09.1.454.CMB.2.raw
  modified_base (307)..(307): a, c, t, g, unknown or other
  misc_feature (307)..(307): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaaacaacaaacactcctgacccctgcccggttcctcacggctcccgtcggttcggggacaacggctcgcccctgaccccgtttcggggtcgcgcagccctgacggatgaggctgagtattactgcttgctctcctataggtgtgttcgggtgttcggcggtagggaccaagctcgaccgtctacggtcacgcccgaaggcctcgcccctcggtcacctctcgtcccacccttccc

SEQ ID NO: 304428 - DNA, 560 bp, Homo sapiens
  misc_feature: GZ8MTXP02IRZT1.17.42.D09.1.454.CMB.2.raw
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggaccactgactttatgataacaaaacaaacaaacactacctacgacccctcgacccggttccctccgacgcctccccgtcggttcgggggacaacggcctcgcccgtcgtacccgtttcgggtcgcgcagcctgngatgagctgagtatacngcttgctctcctatagtggtgttcgggtgttcggcggaggacagcgtcgaccgtcgacggtcagacccgagcctcgccccgtcggtcacctcgtcgttccccacccgttccc

SEQ ID NO: 304429 - DNA, 584 bp, Homo sapiens
  misc_feature: GZ8MTXP02JAL3Z.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaaacagaagcctggccaagcccccaggaccactgattatgatacaaaacaacaaacactcctcgacccctgcccggttcctcacggcctcccgtcggttcggggcaacggctcgccctcgtaccccgtttcggggtcgccgcacgccctggaggagtgaggctgagttattacgtgtcgttgcttctcctagttaggtggttgttcgggtgttcgggcggagggaccaagcgtcgacccgtcgacggtcgacgcccgaacggcctccggcccccgtcggtacctcctccgtaccgttcccctaccccttcccg

SEQ ID NO: 304430 - DNA, 551 bp, Homo sapiens
  misc_feature: GZ8MTXP02H8A63.17.42.D09.1.454.CMB.2.raw
  modified_base (311)..(311): a, c, t, g, unknown or other
  misc_feature (311)..(311): n is a, c, g, or t
  modified_base (405)..(405): a, c, t, g, unknown or other
  misc_feature (405)..(405): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactcggttccaaacagaagcctggaccaacgcccccaggacactgattangataacaaaacaacaaacactcctacgacccctgcccggttcctcgagcctcccgtcggttcggggacaacgctcgccctgaccctttcgggcncgcacgcctgacgagtgagctgagtatactgcttgctctctatagtgtggtcggtgttcggcggaggaccaagctacgaccgtccgtaggtcacgcccaaggcctaccgcccccgtcggtccacctcctccgtccccacccttccc

SEQ ID NO: 304431 - DNA, 666 bp, Homo sapiens
  misc_feature: GZ8MTXP02I0C55.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaacagaagccgtggccaacgcccccaggacactgattatgataacaaaacaaacaaacactacctcgacccctgcccgttcctcacgctccgtcgtcggggacaggctcgccctcgtaccccgtttcgggcgtccgcgacgtcccgtggacggtagtggacggtcgtaggtaaggttaactttacgtcgttacgtttcgtccgtttcccttacccttagtttagggtttcgggttacggtttcggggttcggttcggggtacggggaacgggtaaccgaacggtccgtacggtacccgttacgttacgggtacgtacgacccgaacggtccgtaccggtcccccgtccggtaacctcccgtccgttcccgtttcccccgtacccgtttcccccg

SEQ ID NO: 304432 - DNA, 569 bp, Homo sapiens
  misc_feature: GZ8MTXP02JW9SM.17.42.D09.1.454.CMB.2.raw
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtggagctgtcaccaatggtcattatccctactggttccaaacagaagcctggccaagcccccaggacactgatttangatacaaaacaacaaacactcctagacccctcgcccggttcctcagctccctcggttcggggcacgcgtacgccctcgtaccctttcggggtcgcgcagcccgtgacggntggagcgtgagtattacgtgcttgctctctatagtggtgttcgggtgtcgggcggaggtacgaagctacggaccgtcgtacggtcacggacccaacggtcctcggcccccgtcgggtccaccttcgtccgttccccctacccttccccg

SEQ ID NO: 304433 - DNA, 590 bp, Homo sapiens
  misc_feature: GZ8MTXP02HZI9Y.17.42.D09.1.454.CMB.2.raw
  modified_base (238)..(238): a, c, t, g, unknown or other
  misc_feature (238)..(238): n is a, c, g, or t
  modified_base (506)..(506): a, c, t, g, unknown or other
  misc_feature (506)..(506): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggcctccagcactgganctgtcaccaatggtcattactccctactcggttaccaaacagaagcctggacccaacgccccccaggaccactgatttatagataaacaaaacaaacaaaacactacctacgacccctcgacccggttcctcgacggtcctcccgtcggttcggggacacgtccgtacgccccttcgtaccccgtttcggggcgccgacgacgcccgtggaggagtggaggtctagagtattctgcttgctctctagtgtggtgttcgggtgttcggnggacggacgaagcgtacggaccgtcgtacgcgacgacccgaaggctccgccccgtcgactactccgtccttccccaccttcccg

SEQ ID NO: 304434 - DNA, 569 bp, Homo sapiens
  misc_feature: GZ8MTXP02FNKNH.17.42.D09.1.454.CMB.2.raw
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccatgtcattatcctactggttccaacagaagcctggcccaacgcccccaggacactgattangatacaaacaacaaacactctcgaccctgccgttcncagctcctcggtggggcagcncgccctgtacccgtttgggcgtcgcacgccctgacggatgaggctagtagtattacgtgtcttcgcttctacccttgtaggttggttggtttcgggtggttcgggcgggtacggaccgagcgtacgaccgtcgtacggtcaccgcccgtaacggccgtccggcccccgttacggtcctacctccgtaccgtcccccaccctttccc

SEQ ID NO: 304435 - DNA, 598 bp, Homo sapiens
  misc_feature: GZ8MTXP02GPHQS.17.42.D09.1.454.CMB.2.raw
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagcgtagactagcacgaccggtgctcgatttagacacatacgcagggaaagggggcccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctactggttccaacagaagcctcggccaacgcccccaggacactgattatgatacaaactaacaaacactcctacgacccctcggtcccgttcctcacggtcctcccgtcggttcggggacacgctcgccctgacccgttcgggcgtcgcacgcctgacggatggagctgagtnttacngtcttgctctctatacggtggtggttcgggtggttcggcgggtacgggtacaacgtcgtacggacccgttcgtacggccgtaacggccccgtaagggcccttacggccccccgttcggtacccaccgttaccgtcccgtttccccggtccctttccccg

SEQ ID NO: 304436 - DNA, 545 bp, Homo sapiens
  misc_feature: GZ8MTXP02H3W3T.17.42.D09.1.454.CMB.2.raw
  modified_base (308)..(308): a, c, t, g, unknown or other
  misc_feature (308)..(308): n is a, c, g, or t
  modified_base (415)..(415): a, c, t, g, unknown or other
  misc_feature (415)..(415): n is a, c, g, or t
  modified_base (470)..(470): a, c, t, g, unknown or other
  misc_feature (470)..(470): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatgtcattatccctactggttccaacagaagcctggccaagccccccaggacactgatttangatacaaacaaacaaacactccctagacccctagcccggttctccagctccctcgttcggggcaaggctagccctgtacccctttcggggtcgtcgcagcccgtagnggactgagctgagtatactgacttgctcgtctatacgtgtgttcgggtgttcggnggaggacaagctcgacgtccgtaggtcacgccgaacgctacgcccctcggtccactcgtcgttcccgccttcccg

SEQ ID NO: 304437 - DNA, 649 bp, Homo sapiens
  misc_feature: GZ8MTXP02H0QCF.17.42.D09.1.454.CMB.2.raw
  modified_base (309)..(309): a, c, t, g, unknown or other
  misc_feature (309)..(309): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaacaacaaacactcctcgacccctgacccggttctccacggcctcccgtcggttcgggggaccaaggcctacggtccccctcggtaccccgtttcggggcgccggtcgacgcccgtggacggtagtggaggcgttaggaaggttacttacgtggtcctttcggcttccttaccttagttagggttggttcgggtttcgggggttcggtttcggggacggggtacgggggtaaccaaacgggtcgttacggacccgttaccggtaacggtcaacggcccgaacgtccgtccgcccccgtacggtccaccgtctccgttcccccgtcccttccccg

SEQ ID NO: 304438 - DNA, 588 bp, Homo sapiens
  misc_feature: GZ8MTXP02G7K7Q.17.42.D09.1.454.CMB.2.raw
  modified_base (235)..(235): a, c, t, g, unknown or other
  misc_feature (235)..(235): n is a, c, g, or t
  modified_base (308)..(308): a, c, t, g, unknown or other
  misc_feature (308)..(308): n is a, c, g, or t
  modified_base (569)..(569): a, c, t, g, unknown or other
  misc_feature (569)..(569): n is a, c, g, or t
tcagcgtagactagcacgaccggtgctcgatttagacacatacgcagggaaagggggcccagctctggcaccaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtggctccagcactgganctgtcaccaatggtcattactccctatggttccaaacagaagcctggccaacgcccccaggacactgatttanagataacaaaacaaacaaacactcctacgacccctcgtccgtcctcacggcctccgtcggttaggggacacgctcgccctcgtacccgtttcggggcgcgcgacgcctaggagggtatgaggtcgtaggtaacgttatttaccgtggttcttcggtcttccttaccgttattacgggttggttcggttcggggtaggttcgggcggtaggacctaagctacggccgtctacggcacgccgacgctacgccccgtcggtccncgtctcgtcccgcctcccg

SEQ ID NO: 304439 - DNA, 533 bp, Homo sapiens
  misc_feature: GZ8MTXP02G4HO4.17.42.D09.1.454.CMB.2.raw
  modified_base (308)..(308): a, c, t, g, unknown or other
  misc_feature (308)..(308): n is a, c, g, or t
tcagcgtagactagcacgaccggtgctcgatttagacacatacgcagggaaaggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattaatccctactggttccaacagaagcctggccaagcccccaggacactgatttangatacaaaacaacaaacactcctagacccctgcccggttcctcagcctccctcgttcggggcaaggctagccctgacccgtttgggtcgcgcagcctgaggatgagctgacgtatactgcttgctctctatagtgtgttcggtgttcggcggaggacagcgtacgaccgtctaggtcacgccgacggcctcgccccgtcggctacgtctcgttcccacccttccc

SEQ ID NO: 304440 - DNA, 622 bp, Homo sapiens
  misc_feature: GZ8MTXP02JVQJI.17.42.D09.1.454.CMB.2.raw
  modified_base (309)..(309): a, c, t, g, unknown or other
  misc_feature (309)..(309): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaagcctggccaacgcccccaggacactgattangatacaacaacaaacactcctacgacccctcgccggtcccctcacggctccctcggtcggggacagcgtcacccgtcgtacccgtttcgggtgccgcgacgtcccgtgaggactgagggctggtagttacttacgtgtcgtttcgcctctccttagtacgggttgggttcggtttcgggggttcgggttcggggtcggggaacggggtaccgaacggtccgtcggtacccggttccgtaacgggtccgacggacccgaacggtccgtcccgcccccgtcggtctacctcgttcccgtcccggtcccttccccg

SEQ ID NO: 304441 - DNA, 710 bp, Homo sapiens
  misc_feature: GZ8MTXP02F9W1O.17.42.D09.1.454.CMB.2.raw
  modified_base (505)..(505): a, c, t, g, unknown or other
  misc_feature (505)..(505): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggacgccctcactgactgtcgtccccgagggacgggacagtcactctcacctgtgctccagcacgtggagctgtcaacctaagtgtctattctcctacttcgtaccaacacgaacgcctacggaccaaccgcccccgaggaaccacgtgtaatttatacgtaaactaaacaaaaaccaaaaccaaacctacctaccccgtacggaaccccttcggtaccccggttcctaccgaccggtcccttccccggttacgggtacggggaacctaacgggtcctaccggtcccgttccggtacccggtttcgggcgccgcgtcgtccgtaggagtacgnggagcttagtacgttaacttacgtcgtcgttctaccgttccgttacgttaggttcgggtttgggtcgggtttcggggttcggttacggggacgggtacggaaccgtagtaccggtcgttaccggttacgtacgtaccgacggaccgtacgtcccgtaccgccccgttacgtacctacgttcccgtccgtccccctcctttacccg

SEQ ID NO: 304442 - DNA, 575 bp, Homo sapiens
  misc_feature: GZ8MTXP02FIIUU.17.42.D09.1.454.CMB.2.raw
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaancctggcccaagcccccaggaccactgattatgatacaaaacaacaaacactccncgacccctgcccggttcctcgacgctccctcggttcggggacagctcgccctgacccgtttcgggcncgcgagcctgacggatgaggctgagtattacngtcttgctctcctataggtggtcgttcgggtggttcgggcgggtacgggacccgaaggcgtacggacccggtcgtacggtccgaacgcccgaacggcctacgtccccgtacggtccacttccgtccgttccccgcccttccccg

SEQ ID NO: 304443 - DNA, 830 bp, Homo sapiens
  misc_feature: GZ8MTXP02I9H30.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgccccagggtccaattcccaggctgtggtgactcaggagccctcactgacctgtgtccccaggagggacagtcactctcacctgtggctccagcactggagctgtcaccaatggtcattatcctactggttccaacagaagcctaggccaacgcccccaggaccactgacttatgataacaaaacaaccaaacactaccctacggacccctacggtccccggttcctaccgacgggtcccttcccccggttacggttccggggggacaacggggtcctacgggcccctcgggtaaccccccgtttttgggggtcgacccggtcccgacgtccccgttggaacggggtaacgtagggaaacgggtcccgttacgggtaaggtttaaactttaacccgtagggttcctttacggtaccgtttccctttacccgttaacgttaagggtttacgggggttacggttttcgggggttacggttttccgggggtaccgggggtaacggggaccccgtaaaaggtcccggttacgggaaacccggtttcccgttaaacggggttccgtaaaccgggtacccccggtaaaaggggcccccttttacgggaacccccccccggtttacggggttcccctaaacccggtttacccccggtttacccggtttaccccccggttaccccgtttttacccccccg

SEQ ID NO: 304444 - DNA, 548 bp, Homo sapiens
  misc_feature: GZ8MTXP02FFJZL.17.42.D09.1.454.CMB.2.raw
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaatggtcattatcccctactggttccaaacagaagcctggccaacgcccccaggacactgatttatgatacaaaacaaacaaacactcctcggacccctcgccggtcctcacggctccctcggttcgggggctaagctgccctcgacccgtttcgggtncgtcagcctgaggntgaggctgagtnttatgctgctctcctattacgtgtggttcggggtgttcgggcggaggaccagctcgaccgtccgtaggtcacgcccaaggcctcggcccccgtggtccactctcggtcccgccctcccg

SEQ ID NO: 304445 - DNA, 642 bp, Homo sapiens
  misc_feature: GZ8MTXP02GOD84.17.42.D09.1.454.CMB.2.raw
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtctattactccctactcggttaccaaacagaacgcctcggacccaacgcccccaggtaccactcgtatttaatagaactaaccaaaacaaaacaaaaccgacctacccgtacggaacccctgtaccccggttcctacgacggtccttccccgtcggttcggggacctaacgggcctccggtcccttcggtaccccgtttcgggtcgcgccgacgtcctaggacgagtggaacggtcgtagagttattacgtgtcttgtcttctctagttggtggtcgttgggtcggttcgggcgggtacggacgaaggcgtacggaccgtcgtacggtcgacggccgtaacgccgtccgtccccgtcggtacctacctccgtccgttccccgtcccttcccg

SEQ ID NO: 304446 - DNA, 739 bp, Homo sapiens
  misc_feature: GZ8MTXP02GAWAM.17.42.D09.1.454.CMB.2.raw
  modified_base (463)..(463): a, c, t, g, unknown or other
  misc_feature (463)..(463): n is a, c, g, or t
  modified_base (487)..(487): a, c, t, g, unknown or other
  misc_feature (487)..(487): n is a, c, g, or t
tcagcgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcacgtggacgctgtacaaccaagtggtacattactccctactcggttaccaaacgagaacgcctacggaccaacgccccccgaaggaccacgtagtaatttagtacgaactaaccaaaacaaaccaaaacctaccgtacccgtacggacccctcggccccgtttacctaccgacggtcctccccgtcgggttcggggaaccacggtcctcgtcccgttcgtacccgtttcgggngtcccgcgacgtccgtgacgggtntcgggacggcgtagtacggttacttacgcgttcttcggtacttcccttaccgttaagttagggttcggttcgggtttcgggggttcggtttaccgggggaacggtacggggtaaccctaaacgggtccgttacggtaccccggttaacgtacggggtacccaaccgggtacccgtaacgggtccctaccggtccccccgtacggttccctaccgttcccgtttcccgttaccccctaaccccggtttccccg

SEQ ID NO: 304447 - DNA, 447 bp, Homo sapiens
  misc_feature: GZ8MTXP01BQ92Z.44.30.C08.1.454.CMB.2.raw
  modified_base (353)..(353): a, c, t, g, unknown or other
  misc_feature (353)..(353): n is a, c, g, or t
  modified_base (442)..(447): a, c, t, g, unknown or other
  misc_feature (442)..(447): n is a, c, g, or t
tcagacagtatatacacgaccggtgctcgatttagtctgacgtcaaagggaaagggccgagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctctcagcttccaccaaggcccatcgtcttccccctggcgccctgctccaggngcaccctctgggggcacagcggccctgggctgcctggtcaaggactactcctatactactgtctgagcgggctggcaaggcgcataggnnnnnn

SEQ ID NO: 304448 - DNA, 469 bp, Homo sapiens
  misc_feature: GZ8MTXP01BWAXB.44.30.C08.1.454.CMB.2.raw
  modified_base (458)..(458): a, c, t, g, unknown or other
  misc_feature (458)..(458): n is a, c, g, or t
  modified_base (460)..(469): a, c, t, g, unknown or other
  misc_feature (460)..(469): n is a, c, g, or t
tcagacagtatatacacgaccggtgctcgatttagtctgacgtcaaagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactattgatggatgtctggggcgagggggacgtcggtcaccgtctcctcagcttccaccacgggcccatcggtcttccccctggccgccctcgcctccaggactcaccccgtcgtgggggcacgagccgggccctggggcctggcctggtcaagggactacttcctatatactgtcgagcgggctggcaggcgcatagngnnnnnnnnnn

SEQ ID NO: 304449 - DNA, 498 bp, Homo sapiens
  misc_feature: GZ8MTXP01C9Q8J.44.30.C08.1.454.CMB.2.raw
  modified_base (482)..(482): a, c, t, g, unknown or other
  misc_feature (482)..(482): n is a, c, g, or t
  modified_base (485)..(498): a, c, t, g, unknown or other
  misc_feature (485)..(498): n is a, c, g, or t
tcagacagtatatacacgaccggtgctcgatttagtctgacgtcaaagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcggaggggacctccgaaaggaaacggttgggaatcaataaactactactattgatggatgtcgtgggcgaggggacgtcggtcaccgtctcctcacgctccaccgacggcccagtccggtccttcccccgtcggccgcccctgcctccgaggacgcctaccccgtcggtcgggggcacgcggccgggcccgtgggcctgcccgtggtcaacgggtctaccgttctatactactacgtctgacggcgggcgtcggacgacggcgacagnggnnnnnnnnnnnnnn

SEQ ID NO: 304450 - DNA, 483 bp, Homo sapiens
  misc_feature: GZ8MTXP01DY8BD.44.30.C08.1.454.CMB.2.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (471)..(483): a, c, t, g, unknown or other
  misc_feature (471)..(483): n is a, c, g, or t
tcagacagtatatacacgaccggtgctcgatttagtctgacgtcaaagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccgaaggaaacggttgggaatcaataaactatactatttgatggatgtcgtggggcagggggacgtcggtcaccggtctcctcagcttccaccaaggccccatcggtcttccccgnggccnccctgctccgaggcncacccctcgtgggggcacgacggccggcccgtgggctgcccgttggtaccaacggcttacttccgtattactactgtctgacgcgggtctagggcaaggcgacataggnnnnnnnnnnnnn

SEQ ID NO: 304451 - DNA, 576 bp, Homo sapiens
  misc_feature: GZ8MTXP01EJNEX.44.30.C08.1.454.CMB.2.raw
  modified_base (267)..(267): a, c, t, g, unknown or other
  misc_feature (267)..(267): n is a, c, g, or t
  modified_base (562)..(576): a, c, t, g, unknown or other
  misc_feature (562)..(576): n is a, c, g, or t
tcagacagtatatacacgaccggtgctcgatttagtctgacgtcaaagggaaaggggccggagtgggtggcagtcatctccgacgatggaagtgagaagtattactcagactccgtgaagggccgattcaccatctccagagacaattccaagaatatgctgtatttgacaaatgaacagcgtgagagttgacgacacgtctttgtttatactggtgcggagggggacctaccgaaggaacggttcgggaatcaataaactactatnttgatgatgtcgtggggcgagggggtacgtcggtcaccgtctcctcacgtccttaccgacccgtaacgggcccctaagttcccggttccctttccccccgtcggccccgtccccttcgacctccgacggccgtaccgtacccccggtccggtcggggggaccaccgaccggcccgggccccgttcggggccttcgggcccgtacgggtacgtaaacgggtccttaaacgttacccttattacttacgtcgtccgtggacgggcggggctacgggaccaagggcgacgataggggnnnnnnnnnnnnnnn

SEQ ID NO: 304452 - DNA, 458 bp, Homo sapiens
  misc_feature: GZ8MTXP02JCK07.44.30.C08.1.454.CMB.2.raw
  modified_base (446)..(458): a, c, t, g, unknown or other
  misc_feature (446)..(458): n is a, c, g, or t
tcagacagtatatacacgaccggtgctcgatttagtctgacgtcaaagggaaaggggccgagtgggtggcagtcatctccgacgatggaagtgagaagtattactcagactccgtgaagggccgattcaccatctccagagacaattccaagaatatgctgtatttgcaaatgaacaagcgtgagagttgacgacacgtctgtttattactgtgcgagggggacctccaaggaaacggttcggggaatcataaactactactatttgatggatgtctggggcagggggacgtcggtcaccgtctcctcagcttccaccaggcccatcggtcttcccctggccgccctgcctccagagcaccctctggggcacagcggccctgggctgcctggtcaaggactacttcctatactactgtctgagcgggctgggcaaggcgcgatagnnnnnnnnnnnnn

SEQ ID NO: 304453 - DNA, 375 bp, Homo sapiens
  misc_feature: GZ8MTXP01EFXUU.39.19.B08.1.454.CMB.2.raw
  modified_base (275)..(275): a, c, t, g, unknown or other
  misc_feature (275)..(275): n is a, c, g, or t
  modified_base (369)..(375): a, c, t, g, unknown or other
  misc_feature (369)..(375): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatccggtctcccctggcgccctgcnccaggagcacctccgagagcacagcggccctgggctgcctggtcaaggctacttccactagtgcgacctgagcgggctggcaaggcgcagtagnnnnnnn

SEQ ID NO: 304454 - DNA, 500 bp, Homo sapiens
  misc_feature: GZ8MTXP01ADJTW.39.19.B08.1.454.CMB.2.raw
  modified_base (280)..(280): a, c, t, g, unknown or other
  misc_feature (280)..(280): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (450)..(451): a, c, t, g, unknown or other
  misc_feature (450)..(451): n is a, c, g, or t
  modified_base (453)..(469): a, c, t, g, unknown or other
  misc_feature (453)..(469): n is a, c, g, or t
  modified_base (471)..(500): a, c, t, g, unknown or other
  misc_feature (471)..(500): n is a, c, g, or t
tcagtcgcactagtcacgaccggtgctcgatttagtgagtcagtaagggccgatgcaccatctccagacacaactccaacggcttggtctttctacaaatgaacagtctgggggtcatgacacggctgtatattactgtgcgaggcagtcagattgtggtgtggactgtgacatcaagaactacttctatggagcggtacgtttggggaccaagggaccacggtcaccgtctcagcctccaccaagggcccatccggtccttccccgtggccgccctgcnccgaggcgccacctccgagacgcacgacggccggcccgtggggcctggcccgtgggtaccgaaagggtacccttaccgttacccacgttaaggtcggaccgtaacccgtgggacggtcccgggggcgtcggggaaacccgaaacggggccgaccgtaaagtaggngngcnncnnnnnnnnnnnnnnnnngnnnnnnnnnnnnnnnnnnnnnnnnnnnnnn

SEQ ID NO: 304455 - DNA, 442 bp, Homo sapiens
  misc_feature: GZ8MTXP01DE1ZY.39.19.B08.1.454.CMB.2.raw
  modified_base (427)..(442): a, c, t, g, unknown or other
  misc_feature (427)..(442): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatgggagcggtacggtttggggaccaagggaccacggtcaccgtctcacgcctccaccgaacgggcccatccggtccttcccccgtggcccgccctcgcctccgaggcgccacccgtccgacgacgcacgacggcccggtcccgtggggcctcgccgtacggtacaacggtacctaccttaccacgtacgtgccgtaccgtggacggcgggctcgggaacgaacgggcgacgagtagnnnnnnnnnnnnnnnn

SEQ ID NO: 304456 - DNA, 447 bp, Homo sapiens
  misc_feature: GZ8MTXP01AKFNU.39.19.B08.1.454.CMB.2.raw
  modified_base (432)..(447): a, c, t, g, unknown or other
  misc_feature (432)..(447): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaaagtaactacttctagtggagccgggtacggtttggggaccgaagggaccacggtccaccgtctcagccctccaccgaaggcccagtccggtcccttcccccgtggccgcccgtgcctccgaggacgaccacccgtccgagacgcacgtacgccggcccgtgggcctgcccgtaggtacaacggtacctaccttccaaccgttagcgccgtacctggacggtcggggctcgggaacgaacgggccgacgataggnnnnnnnnnnnnnnnn

SEQ ID NO: 304457 - DNA, 378 bp, Homo sapiens
  misc_feature: GZ8MTXP01D2B2T.39.19.B08.1.454.CMB.2.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (370)..(378): a, c, t, g, unknown or other
  misc_feature (370)..(378): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttgggccaagggccacggtcaccgtctcagcctcacaggccatcgtctccctgcncctncncagcncacctcgagancacagcggccctggggctcgccgtggtacgaacggactaccttccactagtcgcgtacctggagccgggctggaaccaaggcgacagtagnnnnnnnnn

SEQ ID NO: 304458 - DNA, 367 bp, Homo sapiens
  misc_feature: GZ8MTXP01DXCGW.39.19.B08.1.454.CMB.2.raw
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (357)..(367): a, c, t, g, unknown or other
  misc_feature (357)..(367): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctcaccaaggcccatcggtctcccctgcgcctgcnccngancaccncgangcacagcggccctgggctcgcctggtcaaggactactcactagngcactgagcggcngacaaggngcatagnnnnnnnnnnn

SEQ ID NO: 304459 - DNA, 370 bp, Homo sapiens
  misc_feature: GZ8MTXP02G7002.39.19.B08.1.454.CMB.2.raw
  modified_base (366)..(370): a, c, t, g, unknown or other
  misc_feature (366)..(370): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctcaccaaggcccatcggtcttccccctggcgccctgctccaggagcacctccgagagcacagcggccctggctgcctggtcaaggctacttccactagtgcgacctgagcgggctggcaaggcgcatagnnnnn

SEQ ID NO: 304460 - DNA, 374 bp, Homo sapiens
  misc_feature: GZ8MTXP02JKHSK.39.19.B08.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (368)..(374): a, c, t, g, unknown or other
  misc_feature (368)..(374): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaaggcccatcggtctcccctggcnccctgctccaggngccacctccgagngcacagcggccctgggctgcctggtcaaggactacttccactagtgcgacctgagcgggctggcaaggcgcatagnnnnnnn

SEQ ID NO: 304461 - DNA, 372 bp, Homo sapiens
  misc_feature: GZ8MTXP02JH3N6.39.19.B08.1.454.CMB.2.raw
  modified_base (265)..(265): a, c, t, g, unknown or other
  misc_feature (265)..(265): n is a, c, g, or t
  modified_base (361)..(361): a, c, t, g, unknown or other
  misc_feature (361)..(361): n is a, c, g, or t
  modified_base (367)..(372): a, c, t, g, unknown or other
  misc_feature (367)..(372): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaggcccatcggtctcccctggcnccctgctccaggagcacctccgagagcacagcggccctgggctgcctggtcaaggactacttccactagtgcgacctgagcgggctggcaagggcncatagnnnnnn

SEQ ID NO: 304462 - DNA, 372 bp, Homo sapiens
  misc_feature: GZ8MTXP02G2S51.39.19.B08.1.454.CMB.2.raw
  modified_base (292)..(292): a, c, t, g, unknown or other
  misc_feature (292)..(292): n is a, c, g, or t
  modified_base (366)..(372): a, c, t, g, unknown or other
  misc_feature (366)..(372): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaaggggaccacgggtcaccgtctcagcctccaccaaggcccatcggtctcccctggcgccctgctcaggacgcacctcgagngcacagcgccctggctgcctggtcaaggactacttccactagtgcgacctgagcgggctggcaaggcgcatagnnnnnnn

SEQ ID NO: 304463 - DNA, 368 bp, Homo sapiens
  misc_feature: GZ8MTXP02I8LJD.39.19.B08.1.454.CMB.2.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (365)..(368): a, c, t, g, unknown or other
  misc_feature (365)..(368): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaaggcccatcggtcttcccctggcgccctgctccaggngcacctccgagngcacagcggccctggctgcctggtcaaggctacttccactagtgcgactgagcgggctggcaaggcgcatagnnnn

SEQ ID NO: 304464 - DNA, 358 bp, Homo sapiens
  misc_feature: GZ8MTXP02HU0LR.39.19.B08.1.454.CMB.2.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (354)..(358): a, c, t, g, unknown or other
  misc_feature (354)..(358): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccacaaggcccatcggtctccccngcgcctgctcngancactccgangcacngcggccctggctgcctggtcaaggctacttccatagtgcgactgagcgggctggcaggcgcatgnnnnn

SEQ ID NO: 304465 - DNA, 370 bp, Homo sapiens
  misc_feature: GZ8MTXP02GZ0OG.39.19.B08.1.454.CMB.2.raw
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (350)..(350): a, c, t, g, unknown or other
  misc_feature (350)..(350): n is a, c, g, or t
  modified_base (357)..(370): a, c, t, g, unknown or other
  misc_feature (357)..(370): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctcaccaggcccatcgtctccccngcncctgctcagncncctcgangcacagcggccctggctgcctgtcaaggctacttccactagtgcgacctgacgcgggctggcaagggcncagtagnnnnnnnnnnnnnn

SEQ ID NO: 304466 - DNA, 416 bp, Homo sapiens
  misc_feature: GZ8MTXP02H4R2W.39.19.B08.1.454.CMB.2.raw
  modified_base (178)..(178): a, c, t, g, unknown or other
  misc_feature (178)..(178): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (394)..(416): a, c, t, g, unknown or other
  misc_feature (394)..(416): n is a, c, g, or t
tcagtcgcactagtcacgaccggtgctcgatttagtgagtcagtaagggccgatgcaccatctccagacacaactccaacggcttggtctttctacaaatgaacagtctggggggtcgatgacacggctgtatattactgtgcgaggcagtcagattggtggtgtggactgtgacatnaaagaactacttctatggagcggtacgtttggggaccaagggaccacggtcaccgtctcacgccctaccaaccgaacgggccctagtccggtcccttcccgcggcccgtcctcgcctacgagacnccaccgcgagcgcacgcggccgcgnggctcgcgtgacaacgtctactacacgtagngcgcgnggcggcggcgcggacgacggcgacagtgnnnnnnnnnnnnnnnnnnnnnnn

SEQ ID NO: 304467 - DNA, 528 bp, Homo sapiens
  misc_feature: GZ8MTXP01DQPJV.25.15.B04.1.454.CMB.2.raw
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
  modified_base (515)..(515): a, c, t, g, unknown or other
  misc_feature (515)..(515): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgagccaggccaatctccaagcgcctaattaataaggtttctaaccgggactcgggggtccagacagattnagcgcaagtgcgtcaggcactgatttcacactagaaatcagcagggtagaggntgaggagtggttggggtttattacggtgcatgacaaaggcacaactactcgggtcctttcgcgttttcgggccccgttggggaccgaggagtggagttattcaagtacgaactggnggttctgctaacc

SEQ ID NO: 304468 - DNA, 538 bp, Homo sapiens
  misc_feature: GZ8MTXP01CI7UE.25.15.B04.1.454.CMB.2.raw
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggcgcctaattaataaggtttcaaccgggactcgggggtcccagacagattcagcgcaagtgcgtcaggcactgatttcacactagaaaatcagcagggtgaggngngagtgtgttgttagtagtgngnagacgagacgacacacgtcgtccgttcgttcgttcggtccggttcgggtacggaggtaggtaggttagttacgttacgtaacgtacgtaacgtcggtcggttcgtcgcgtaacg

SEQ ID NO: 304469 - DNA, 515 bp, Homo sapiens
  misc_feature: GZ8MTXP01BQS7D.25.15.B04.1.454.CMB.2.raw
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgaggccaggccaaatctccaagcgacctaattaataaggtttctaaccgggactcgggggtccagacagattcagcgcaagtgcgtcagggcactgattcacactagaaatcagcaggtgagctgagatgtgggttatgtagcatgcaggcacacactggtcctttcgngtttcgggcccgttggggacgttaggaaggtgggagttnttacaagtacgaacgtggtcgttctcgcgtaac

SEQ ID NO: 304470 - DNA, 509 bp, Homo sapiens
  misc_feature: GZ8MTXP01COAVH.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggctccatctcctgcaagtctagtcaaagcctcgtctacattgacggaaacacctactgcattggttccagctgaggccaggccaatctccaaggcgcctaattaataaggtttctaaccgggactcgggggtcccagacagattcagcggcaagtgcgtcagggcactgatttcacactgaaaatcagcagggtgaggctgagatgttgggttatacgtgcatgcaaggcacacactggcctttcggctttcgggcccttggggacgaggagtgggattgttcaatacgaactggtggctgctaacc

SEQ ID NO: 304471 - DNA, 596 bp, Homo sapiens
  misc_feature: GZ8MTXP01DXF36.25.15.B04.1.454.CMB.2.raw
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacagccgcctccatctcctgcaagtctagtcaaagcctcgtctacattagacgaaacacctacctgcattggtccagctgagccagccaaatcacaagcactaaattaataagtttctaaccggacgtcggggaccagacagatcagcggcaagtgcgtcagcactgattcaacacgtaaanaanagagagaggaggaggagtaggaggtagttaggtttagggtttagttacggtagtacgtagtacgacgaacgacgaacgtaaccgtaccgttccggttcccgtttccggttccggtttccgggtacccgggttacggggtacggttaacggtaggtaaggttagttacgttacgtaacgtaacgtaacgtacggtcggttacgtcgttaaccgtaacg

SEQ ID NO: 304472 - DNA, 510 bp, Homo sapiens
  misc_feature: GZ8MTXP01ERRD6.25.15.B04.1.454.CMB.2.raw
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggtccagctgaggcaggccaatctcaagcgactaaattaataaggtttctaaccgggactcgggggtccagacagatcagcgcaagtgcgtcaggcactgattcacactagaaaatcgagcagggtggaggctagaggtatggttagggttatacgtgctanganaagcacacncgtgtccttcgtcggttcgggccgttgggacgagaggtagattnttacaatacgaacgtggtgctcgcaac

SEQ ID NO: 304473 - DNA, 505 bp, Homo sapiens
  misc_feature: GZ8MTXP01E3YI5.25.15.B04.1.454.CMB.2.raw
  modified_base (406)..(407): a, c, t, g, unknown or other
  misc_feature (406)..(407): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaaatctcaagcgacctaaattaataaggtttctaaaccgggactcgggggtcccagacagattcagcggcaagtgcgtcaggcactgatttcaacactagaaaatcagcagggtgaggnngagtgtggttggttatgtgnangacagcacacncgtcgtccttcgtcgttcgggccgttgggacgagagtgattnacaatacgaagtgngctcgcaac

SEQ ID NO: 304474 - DNA, 566 bp, Homo sapiens
  misc_feature: GZ8MTXP01AH32H.25.15.B04.1.454.CMB.2.raw
  modified_base (260)..(260): a, c, t, g, unknown or other
  misc_feature (260)..(260): n is a, c, g, or t
  modified_base (468)..(468): a, c, t, g, unknown or other
  misc_feature (468)..(468): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctctgtcacccttggacagccggcctccatctcctgcaagtctagtcaaagcctcgtctacattgacggaaacacctacngcattggttccagctgagccaggctaatctaccaaggcgaccttaaattaattaaggtttacgtaaccgggacgtcggggtcccagaccagattcgagcgacagtgcgtacgaggcactgtattacacactagaaatcgagcgaggggtaggaggctgggaggtagttgggtttaggggtttattacgtgcaagtgacgaaggcaacnctacgtcgtcccgtttcgtcgttcgggcccgtagggacgtaggaggttggattaccctaagaacgtaacggtaactggttacgggtcttcggtaaccc

SEQ ID NO: 304475 - DNA, 553 bp, Homo sapiens
  misc_feature: GZ8MTXP01D7ATR.25.15.B04.1.454.CMB.2.raw
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (388)..(388): a, c, t, g, unknown or other
  misc_feature (388)..(388): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctcctctccgtcncctgacngccgctcatctctgcaagtctagtacaaagcctcgtctacattcgaacggaaacacctacctgctattcggtcagctgacgcagcatcacgagctactaatagtagtttacgaacggcgtcgggtccagacacgatcagcgcaagtgcgtcaggcatgtattcacgtactaagaaatcgagcgagggtggacgngtaggagtagttgggtttagggtttacttaggttgacgtagtagacgaacggacacgtacgtacgttcggtccgtttcgttcggttcgggtccgttacgggacggaggtagtgggttacttacgttacgtaacgtacgtaacgtcggtcggcgtcgttcgtaacc

SEQ ID NO: 304476 - DNA, 524 bp, Homo sapiens
  misc_feature: GZ8MTXP01C9QD0.25.15.B04.1.454.CMB.2.raw
  modified_base (443)..(443): a, c, t, g, unknown or other
  misc_feature (443)..(443): n is a, c, g, or t
  modified_base (495)..(495): a, c, t, g, unknown or other
  misc_feature (495)..(495): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctcaaggcgctaattaataaggtttcaaccgggactcgggggtcccagacacgattcagcggcaagtgcgtcaggcactgatttcacactagaaaatcagcaggggtgaggctgaggatggttggggtttattacgtgcatgacaaggcacacncgtggtccctttcggcgttttcgggcccgttggggacgaggtaagtggattnttctaatacgaactggtgctcgctaaccg

SEQ ID NO: 304477 - DNA, 593 bp, Homo sapiens
  misc_feature: GZ8MTXP01DZPNK.25.15.B04.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (406)..(406): a, c, t, g, unknown or other
  misc_feature (406)..(406): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacacgccgcctccatctcctgcaagtctagtacaaacgcctcgtctacattgacgaacnctacngcatgtccagctgacgcagcaatctacaagcgactaattaataacggtttcaaccgggacgtccgggggtccagacacgattcgagcgcaagtgcgtcacgggctactgtattcacactagaaatcgagcgagggtggagctggagtntggttgggtttattacgtgctagtcgataagtgaccaacgtaccgtaacgttcggggttcccttttcggtccggttttcggggttccccgttagggggaaccgtaacgggtagggttacgggttaattacggttaaccctaaagttaacccggtaaacgttgggttacgggtcctttcgggaacccc

SEQ ID NO: 304478 - DNA, 534 bp, Homo sapiens
  misc_feature: GZ8MTXP01AIG9V.25.15.B04.1.454.CMB.2.raw
  modified_base (412)..(412): a, c, t, g, unknown or other
  misc_feature (412)..(412): n is a, c, g, or t
  modified_base (523)..(523): a, c, t, g, unknown or other
  misc_feature (523)..(523): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctccaaggcgacctaattaataaggtttacgtaaccgggacgtcgggggtcccagacacgattcagcggcaagtgcgtcgaggcactgattcacactagaaaatcgaagcgaggggtggaggntggaggtagttggttaagggtttattacgtgcatgacaaggcacacacgtgtcctttcgcgtttcgggcccgttggggacgaggagtggattcgttcaagtacgaacgtgnggctgctaacc

SEQ ID NO: 304479 - DNA, 503 bp, Homo sapiens
  misc_feature: GZ8MTXP01DBHFF.25.15.B04.1.454.CMB.2.raw
  modified_base (422)..(422): a, c, t, g, unknown or other
  misc_feature (422)..(422): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggctccatctcctgcaagtctagtcaaagcctcgtctacattgacggaaacacctacctgcatggttccagctgagccaggccaatctccaagcgcctaattaataaggtttcaaccgggactcgggggtccagacagattcagcgcaagtgcgtcaggcactgatttcacactgaaatcagcagggtgagctgagatgttggggtttactagtgcaatgnaaggcacacactggtcctttcggtcgtttggggccccttgggacgagagtggattnttcaatacgaattgnggctgctaac

SEQ ID NO: 304480 - DNA, 526 bp, Homo sapiens
  misc_feature: GZ8MTXP01D33O4.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgaggccaggccaatctccaaggcgacctaattaataaggtttctaaccgggactcgggggtcccagacagattcagcggcaagtgcgtcaggcactgatttcacactgaaaatcagcagggtgagctgagagtgtgggttagttacgtgtgatgcaaggcgacacactcggtccgtttccgtcgtttcgggtccgttcgggccggaggaggtgggagttattacaatacgtaacgtgtggctggcgtaaccc

SEQ ID NO: 304481 - DNA, 505 bp, Homo sapiens
  misc_feature: GZ8MTXP01DPENT.25.15.B04.1.454.CMB.2.raw
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggctccatctcctgcaagtctagtcaaagcctcgtctacattgacggaaacacctacatgcattggttccagctgaggccaggccaatctccaaggcgcctaaatttaataaggtttctaaccgggactcgggggtcccagaccagattcagcggcagtgcgtcaggcactgattcacactagaaaatcagcagggtggaggctgagatgttggggttattactgcagtgcaaggcacacactggcctttgctttgggcctgggacgagngttggnttatcagtaacgaactgttgcttgaacc

SEQ ID NO: 304482 - DNA, 503 bp, Homo sapiens
  misc_feature: GZ8MTXP01BM9S4.25.15.B04.1.454.CMB.2.raw
  modified_base (346)..(346): a, c, t, g, unknown or other
  misc_feature (346)..(346): n is a, c, g, or t
  modified_base (479)..(479): a, c, t, g, unknown or other
  misc_feature (479)..(479): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggtccagctgagcaggccaatctccaaggcgacctaattaataaggtttctaaccgggactcgggggtcccagacagattnagcggcaagtgcgtcaggcactgatttcacactagaaaatcaagcagggtgaggctgaggatgttggggtttatacgtgcatgcaagcacacactggcctttcgctttgggcccgttgggcgagagtggattnttcaatagaactgtggctgcaacc

SEQ ID NO: 304483 - DNA, 574 bp, Homo sapiens
  misc_feature: GZ8MTXP01C9H3G.25.15.B04.1.454.CMB.2.raw
  modified_base (412)..(412): a, c, t, g, unknown or other
  misc_feature (412)..(412): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattagacggaaacacctacctgcattggttccagctgacggccaggcccaatctccaaggcgactaaattaataaggtttacgtaaccgggactcgggggtaccagacacgattcgagcggcaagtgcgtcaggcactgattcactactagaaaatcagcgagggtggagnaggagagtggttaggggtttattacggtgacgatacgacgaaaggccaacacacgttgggtccctttcggcggttttaacggggcccgttggggaacgaggtaagtagggttattacgttccgaataaccggaacgttggtcgggcttcggaaccttaaccg

SEQ ID NO: 304484 - DNA, 512 bp, Homo sapiens
  misc_feature: GZ8MTXP01DHUYV.25.15.B04.1.454.CMB.2.raw
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggctccatctcctgcaagtctagtcaaagcctcgtctacattgacggaaacacctacctgcattggttccagctgaggccaggccaatctccaaggcgcctaaattaataaggtttctaaaccgggactcgggggtcccagacagattcagcggcaagtgcgtcagggcactgatttcaacactgaaaatcagcagggtgaggctgagatgtggggttattacgtgcaatgnaaggcanaacactggctttcgctttaagggcccttggggacgagagtgggattnttcntacggaatgtggctgctaacc

SEQ ID NO: 304485 - DNA, 551 bp, Homo sapiens
  misc_feature: GZ8MTXP01CAFTP.25.15.B04.1.454.CMB.2.raw
  modified_base (407)..(407): a, c, t, g, unknown or other
  misc_feature (407)..(407): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggccgactaattaataaggtttctaaccgggacgtcgggggtccagacacgattcagcgcaagtgcgtcaggcactgatttcacactagaaaatcagcgagggtaggaggngtggaggtagttggtttaggggtttattacggtgactagtgacgaaggcacgactacgtcggtccgtttcgtcgtttcgggcccgttgggacgaggtaggtgagttcttaccgtaatacgtaacgtggtaggctcgcgtaaccg

SEQ ID NO: 304486 - DNA, 549 bp, Homo sapiens
  misc_feature: GZ8MTXP01AO8PA.25.15.B04.1.454.CMB.2.raw
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (537)..(537): a, c, t, g, unknown or other
  misc_feature (537)..(537): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacacgccgcctccatcctcctgcaagtctagtcaaagcctcgtctacattgacgaaacactacctgctattggtccagctgaggccaggccaatctaccaaggcgacctaaattaagtaacggtttccgtaaccgggcgttccgggggacccagacagattcgagcgcaaagtcgcgtcacggcactgatttcaactactagaaaactcgagacgagggtggagngtgaaggtnttgggtttacgggtttatacgggtgagtaatcggacgaaaggcaacacgtacgtcggtccgtttcgcgtttcgggccgttgggaagttgagtgattgcaatacgaangtggctgaactc

SEQ ID NO: 304487 - DNA, 567 bp, Homo sapiens
  misc_feature: GZ8MTXP01A9SFU.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggcgacctaattaataaggtttctaaccgggactcgggggtccagacacgattcagcggcaagtgcgtcagggcactgattcacactagaaaatcagcagggtggaggctagaggatggttaggggtttattacgtgcatgacaaggcacacgactcgggtcctttcgcgttttcggggccccgttgggggacccgagggtaggtcggggttaacttagttaccgtaagttaacggtaaccgttgggttgggccgttcgggcctaaccccg

SEQ ID NO: 304488 - DNA, 516 bp, Homo sapiens
  misc_feature: GZ8MTXP01BLVCY.25.15.B04.1.454.CMB.2.raw
  modified_base (315)..(315): a, c, t, g, unknown or other
  misc_feature (315)..(315): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatctcctgcaagtctagtcaaagcctcgtctacattgacgaaacacctactgcattcggtccagctgagccagccaatctacaagcgactaataatagttcaaccggngtcgggtccagacagatcgagcgcaagtgcgtcaggcactgactttcaacactagaaatacagagagggaggaggagtagaggtaagttggtttagggtttagttaacggtgtagtagtagagaaggacacactacgtcgtcgttcgtcgttcggtcgttcggagngagtgagnttnaatacgaagtgtgcgtcgcgaacc

SEQ ID NO: 304489 - DNA, 548 bp, Homo sapiens
  misc_feature: GZ8MTXP01D7LBS.25.15.B04.1.454.CMB.2.raw
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttcagctgaggccaggccaaatctaccaaggcgacctaaatttaataaggtttctaaccgggactcgggggtccagacagattcgagcgcaagtgcgtcaggcactgattcacactagaaatcagcgagggtgagntgagatgttgggttatacggngctatgacaaggcaanactacgtcggcctttcggccgtttgggcccttagggggaccgaggtacggtggaacttagttacgtaagttaacggaacgttggtcgggttccttggcccgtaaccg

SEQ ID NO: 304490 - DNA, 638 bp, Homo sapiens
  misc_feature: GZ8MTXP01EJVYT.25.15.B04.1.454.CMB.2.raw
  modified_base (603)..(603): a, c, t, g, unknown or other
  misc_feature (603)..(603): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacagccgcctcatctcctgctaagtctagtacaaacgtccctcgtactaactagttacggaaaccggaaaccaccctaacctgactaagttcgggttcccaagtctaggacggcccaaggcccaaatcctacccgaaagggcctaccttaaaatttaaagtaacgggttttaccgtaaccggggaccgttccgggggtacccaaggaccaggacttcgagcggcaaagtcgcgtcaggcacgtgtactttcaactacgtagaaaactcgagcggaggggtaggagtgtaggaggtagttgggtttaggggtttataacgggttgacgtaagtcgacgaacggcaacgaacgtcgttcgggtccttttcggcgttttcggggacccttggggacttagaggtcggattncctaagtacaacgttgggcggttactgccttaacg

SEQ ID NO: 304491 - DNA, 672 bp, Homo sapiens
  misc_feature: GZ8MTXP01AL2SV.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacacgccggcctccatctcctgcaagtctagtacaaagcctcgtctacattgacggaaacacctactgcatggttcagctgagccaggcaatctcaacggcgacctaattaataaggtttacgtaaccgggtacgtcgggggtccagacacgattcagcggcaacggtgcgtcgagggcacgtgtactttacaactactaagaaaatccgaaggtcgaaggggttaggggacggacgttagggaagggtagttaggggtttagggggttttaattacgggttaggtaccgtaagttcggaacgaaaacgggccgaaacaacgtacggttcggttcccgttttcccgggtcggttttccgggggtaccccgttagggggaaaccggttcgggtaaagggtcggggttaaacttagtttacccggaagttaaccgggaaaccgtttgggacggggttaccttcgggcccctaaaccgg

SEQ ID NO: 304492 - DNA, 542 bp, Homo sapiens
  misc_feature: GZ8MTXP01AYV08.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacgaacacctacctgcatgttccagctgagccagccatctcagcgctaatataagtttcaacggactcggggtccagacagatcagcgcaagtgcgtcaggcactgatttcacactagaaaatcgagcgagggtacggagtagtggaaggtagttggttagggggtttattacggttggctaagtgacaagggcaacacgtacgtcgggccttttcggcgttcgggccccgttaggggaccgttaggaggtgggattgacctaagtacgtaaccgtgggtcggcttcgcgtaacccg

SEQ ID NO: 304493 - DNA, 564 bp, Homo sapiens
  misc_feature: GZ8MTXP01EDGQ2.25.15.B04.1.454.CMB.2.raw
  modified_base (427)..(427): a, c, t, g, unknown or other
  misc_feature (427)..(427): n is a, c, g, or t
  modified_base (535)..(535): a, c, t, g, unknown or other
  misc_feature (535)..(535): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacggaaacacctactgcattggttccagctgaggccaggccaaatctaccaaggccgaccttaaattaaagtaacggttttaccgtaaaccggggacgttccgggggtacccaagacagattcgagcggcaagtgcgtcaggcactgtactttcacactagaaaatcgagcgaagggtggagngtgaggagtggttagggtttagttagttgtcgagtagacgaaggacgacacacgtcgtccgttcgtcgttcgggtccggttcgggacggagaggtggttagttattanaagtacgtaacgtgtggcgtcgcgtaacc

SEQ ID NO: 304494 - DNA, 551 bp, Homo sapiens
  misc_feature: GZ8MTXP01ARYU8.25.15.B04.1.454.CMB.2.raw
  modified_base (515)..(515): a, c, t, g, unknown or other
  misc_feature (515)..(515): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctccaaggcgacctaaattaactaaggtttctaaccgggacgtcgggggtacccagacagattcagcggcaagtgcgtcagggcactgtattcacactagaaaatcagacaggggtcggaggctggaggtatggttggggtttatacgtgtacagtgacaaggcaacgactacgtcggtccgtttcgcgtttaacggggcccgttggggacgaggaggtgggattnttcgaagtaccgaagttcggtaggcgtgcgtaaccg

SEQ ID NO: 304495 - DNA, 545 bp, Homo sapiens
  misc_feature: GZ8MTXP01C5RQ6.25.15.B04.1.454.CMB.2.raw
  modified_base (350)..(350): a, c, t, g, unknown or other
  misc_feature (350)..(350): n is a, c, g, or t
  modified_base (401)..(401): a, c, t, g, unknown or other
  misc_feature (401)..(401): n is a, c, g, or t
  modified_base (450)..(450): a, c, t, g, unknown or other
  misc_feature (450)..(450): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgctattggttccagctgaggccaggccaatctcaagcgactaattaataaggtttcaacgggtctcgggggtccagacagattcagcgnaagtgcgtcaggcacgtgacttcaacactagaaatcgagcaggggtgaggntgaggtatggttacgggtttattacgtgctatggacaaggcacgtaacnctggtcctttggtccgtttcggggcccgttggggacgaggtaggtaggttattagttactaagtaacgaacgtggtggttctcgaacgtaacccg

SEQ ID NO: 304496 - DNA, 568 bp, Homo sapiens
  misc_feature: GZ8MTXP01DX0A6.25.15.B04.1.454.CMB.2.raw
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (555)..(555): a, c, t, g, unknown or other
  misc_feature (555)..(555): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctcccctctccgtcacccttggacacgccgcctccatctcctgcaagtctagtcaaagcctgtctacattagacggaaacacctactgctattggttccagctgaggccagccaatctacaaggcgacttaaattaaagtaggtttactaaccgggacgtccgggggtaccagacagattcgagcgnaagngcgtcaggcactgtacttcaacactagaaaatcgagcgaggggtggaggtctagggaggtagttgggtttacggggtttatacggtgtacagtgacgaagtacacgtaaccgcgttcggtccgttttcggcgttttcgggcccttggggaccgaggaagtggttaacttcttacgaattacgaacgttgnggctcgcctaacc

SEQ ID NO: 304497 - DNA, 603 bp, Homo sapiens
  misc_feature: GZ8MTXP01CP1QL.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttgacagccgcctcatctcctgcaagtctagtcaaagcctcgtctacattgacgaacacctactgcattgtccagctgagccagccaatctccaaggcactaaattaagtaaggtttacaaccgggacgtcgggggtaccagacacgattcgagcggcaagtcgcgtcagggcagtgtactttacacactagaaaatcgagcgagggtggaggctaggaggtagttgggtttaggggtttattacggtgacgtagtcggacaacggcaacgtacgtaccgttcgggttcccgttttcgggtccggttttcggggccccgttgggggaaccgagggtaaacggtgggttaacttacgttacgtaagttaaccggtaagttcgggtacggttacgttcggaaccgttaacccg

SEQ ID NO: 304498 - DNA, 569 bp, Homo sapiens
  misc_feature: GZ8MTXP01AVE2Q.25.15.B04.1.454.CMB.2.raw
  modified_base (362)..(362): a, c, t, g, unknown or other
  misc_feature (362)..(362): n is a, c, g, or t
  modified_base (534)..(534): a, c, t, g, unknown or other
  misc_feature (534)..(534): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgaacggaaacacctacctgcattggtccagctgaggccaggccaatctccaaggcgacctaaattaagtaaggtttccgtaaccgggacgtccgggggtccagacacgattcagcgnaagtgcgtcaggcactgtatttcaacactagaaaatcgaagcgaggggtaggaggctggagggtagttgggtttaggggtttattacggtggactagtggacgaaaggccaacacgtacgtcggtcctttcgcgtttcgggcccgttggggacgttaggaggtggttacttnttcaagtaccgaagttggtcgggctcgccgtaacg

SEQ ID NO: 304499 - DNA, 537 bp, Homo sapiens
  misc_feature: GZ8MTXP01CUCP2.25.15.B04.1.454.CMB.2.raw
  modified_base (276)..(276): a, c, t, g, unknown or other
  misc_feature (276)..(276): n is a, c, g, or t
  modified_base (385)..(385): a, c, t, g, unknown or other
  misc_feature (385)..(385): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagtcctcgtctacattgacggaacacctactgcattgtccagctgngcagccaatctcagcgctaatataagtttcaacgggctcgggtccagacacgattcagcgcaagtgcgtcagggcactgatttcacactgaaatcagcgagggtgagcngaggatggttaggggtttattacgtggctagtgacaaggcacactacgtggtccctttcggccgttttcggggcccttgggggaccgaggtaggtgggttaattcgttacgtaagttaccggaacgttggtcggacttcggccgtaaacccg

SEQ ID NO: 304500 - DNA, 580 bp, Homo sapiens
  misc_feature: GZ8MTXP01EXS4G.25.15.B04.1.454.CMB.2.raw
  modified_base (287)..(287): a, c, t, g, unknown or other
  misc_feature (287)..(287): n is a, c, g, or t
  modified_base (446)..(446): a, c, t, g, unknown or other
  misc_feature (446)..(446): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacagccgcctcatctcctgcaagtctagtcaaagcctcgtctacattagacgaacacctacctgcattggtccagctgagccaggccaatcnccgaagcgacctaaattaataacggtttactaaccgggacgtcgggggtacccagacagattcagcgcaagtcgcgtcgaagggcacgtgtatttcaacactagaaaatcgagcgaggggtgaggtctaggaggtagttggttaggggtttattacggngtacgagtcgacgaaggcaacgtacgtacgtcggtcccgtttcggcgtttaacggggcccgttagggggacgttagggtagtgggattacacgtaagtaccgtaacgtggttacgggcttcggaaccgtaaccg

SEQ ID NO: 304501 - DNA, 568 bp, Homo sapiens
  misc_feature: GZ8MTXP01CZ8ZD.25.15.B04.1.454.CMB.2.raw
  modified_base (410)..(410): a, c, t, g, unknown or other
  misc_feature (410)..(410): n is a, c, g, or t
  modified_base (507)..(507): a, c, t, g, unknown or other
  misc_feature (507)..(507): n is a, c, g, or t
  modified_base (524)..(524): a, c, t, g, unknown or other
  misc_feature (524)..(524): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgctccatctcctgcaagtctagtcaaagcctcgtctacattgacggaaacacctactgcattggttccagctgagccaggccaatctaccaaggcgacctaaattaataaggtttaccaaccgggtacgtcgggggtcccagacagattcgagcgcaagtgcgtcaggcactgattcactactagaaaatcgagcgagggtaggaggngtaggaggtagttgggtttaggggtttattacggtgtacgagtcgacgacggcactacgacgtcggtcctttcgcgtttcgggcccgttggggacgnggtaagtggttacgttnttacgaagtaaccgaacgttggcggttcttcgaaccgttaaccg

SEQ ID NO: 304502 - DNA, 570 bp, Homo sapiens
  misc_feature: GZ8MTXP01AXC7Z.25.15.B04.1.454.CMB.2.raw
  modified_base (392)..(392): a, c, t, g, unknown or other
  misc_feature (392)..(392): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctacaaggcgacctaattaataacggtttctaaccgggactcgggggtcccagacagattcagcggcaagtgcgtcaggcatgattcacatagaaatacacgngagggtaggagggagtagaggtagttaggttagggtttagttacggtgtagtagtacgacgacgacgacgacgtacgtcggtccgttccgttcggttcgggtccggttacgggtacggaggtaggtagttacgttacttacgtaacgtacgtaacgtcggtcggttcgtcgcgtaacg

SEQ ID NO: 304503 - DNA, 534 bp, Homo sapiens
  misc_feature: GZ8MTXP01DHY5Q.25.15.B04.1.454.CMB.2.raw
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacgaacnctactgcatgtcagctgagcagcatcncagcactaatagtagttcaacggacgtcgggtccagacagattcgagcgcaagtgcgtcaggcactgtacttcacactagaaatcgagcgagggtagaggcgtgaggtagtggtttggggtttattaacgtgcgtagtcgacgaaacggcacgtactacgtcggttcccgtttcgcggtttaacgggcccgttggggtaacgaggtagtggttaattcgttactaacgtaacgaacgttggtggctcgcgtaaccg

SEQ ID NO: 304504 - DNA, 619 bp, Homo sapiens
  misc_feature: GZ8MTXP01EBATE.25.15.B04.1.454.CMB.2.raw
  modified_base (267)..(267): a, c, t, g, unknown or other
  misc_feature (267)..(267): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacacgccgcctccatctcctgctaagtctagtacaaacgtcctcgtactacattgaacaagaaacacctaccngctattggtccagctgacggccagccatctccaaaggcgtaccttaaatttaagttaacggtttacgtaaccgggtaccgtccgggggtacccagaccagtattacgagcggacagtcgcgtacgacgggctagtgtactttacaactacgtaagaaaactcaggacgtaaggggtagggaggtacgtggaagggtagttgggttttagggggttttattacgtggtactagtacgacgaaggcaaacgtacgtaccgttcggtcccgtttccgtcggtttcgggcccgtagggttacgagggtagttaggttacttagtcaacgtaacgtaacgtggcggtcttgtaaccc

SEQ ID NO: 304505 - DNA, 567 bp, Homo sapiens
  misc_feature: GZ8MTXP01B7N9B.25.15.B04.1.454.CMB.2.raw
  modified_base (275)..(275): a, c, t, g, unknown or other
  misc_feature (275)..(275): n is a, c, g, or t
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgacggaacacctactgcatggtccagctgnggccaggccaatcctacaaggcgtacctaaattaagtaaggtttctaaccgggacgtcgggggtcccagacgagattcgagcgcaagtgcgtgaggcatgatttcacactanaaatcagcgagggtggaaggctaggaggagttgggttagggtttattacggtgngtacgtaggacgaaggccaacgtaccgtagttccggtaccgtttcggccgttttcggggcccgttaggggaccgaggtaaggtggttattacttacgaagtactaacgtggtgacttcgctaaccg

SEQ ID NO: 304506 - DNA, 533 bp, Homo sapiens
  misc_feature: GZ8MTXP01DYVEB.25.15.B04.1.454.CMB.2.raw
  modified_base (502)..(502): a, c, t, g, unknown or other
  misc_feature (502)..(502): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctgtctacattgacgaaacacctacctgcatggtccagctgaggcagccaatctcaaggcactaaattaataaggtttcaaccgggactcgggggtaccagacagattcagcgcaagtgcgtcagggcactgactttcaacactagaaaatcgagcgagggtggaggctggagtagtggttagggtttatacgtgcgtaatgacaaggcacaacgcgtggtcctttcggcgtttcggggcccttggggaccgttaggacggttgggaattnttacgtaatacgaactggtgcttggctaacg

SEQ ID NO: 304507 - DNA, 515 bp, Homo sapiens
  misc_feature: GZ8MTXP01CBL2X.25.15.B04.1.454.CMB.2.raw
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacagccgctccatctcctgcaagtctagtcaaagcctcgtctacattgacggaaacacctacctgcattggttccagctgaggccaggccaatctccaaggcgacctaattaataaggtttctaaccgggactcgggggtccagacagatcagcgcaagtgcgtcaggcactgatttcacactagaaaatcagcaggggtagaggntgagatgttgggttattacgtgcatgacaaggcanacactggtcctttcgtcgtttcgggcccttaggggacgaggagtgggattagctaatacgaatggtcggctggctaaccg

SEQ ID NO: 304508 - DNA, 546 bp, Homo sapiens
  misc_feature: GZ8MTXP01CP8ON.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctcaaggcactaattaataaggtttcaaccgggactcgggggtaccagacagatcagcgcaagtgcgtcagggcacgtgactttcactactagaaaatcaagcgaggggtggaggctaggaggtattggttacggggtttattacggtgctagtcgacgaaggcaacgacacgtcggtcctttcgcgtttcgggcccttggggacgaggtaagtggacttgttccgaagtacgtaacgtggtggacttcgctaaccg

SEQ ID NO: 304509 - DNA, 586 bp, Homo sapiens
  misc_feature: GZ8MTXP01DCH4J.25.15.B04.1.454.CMB.2.raw
  modified_base (259)..(259): a, c, t, g, unknown or other
  misc_feature (259)..(259): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacgaaacacctaccngctattcggttccagctgacggccaggccaaatctccaaaggcaccttaaattaaagtaaggtttaccgaaccgggacgtcgggggtaccagacagattcgagcgganaagtgcgtcgaggcatgtattcactactagaaaatcagcgagggtaggaggtntagagggtagttgggttagggtttacttagtgtagtatgacgaaaggcacaaccgcgttcgggtcctttcggcgttttcgggcccttgggggacgaagtaggtggttaattacgttcctaagttaaacgtaacgtttggtaccgggttacgtaacgaaccgtaacg

SEQ ID NO: 304510 - DNA, 544 bp, Homo sapiens
  misc_feature: GZ8MTXP01DUIXG.25.15.B04.1.454.CMB.2.raw
  modified_base (506)..(506): a, c, t, g, unknown or other
  misc_feature (506)..(506): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacagccgctccatctcctgcaagtctagtcaaagcctgtctacattgacggaaacacctactgcattggttccagctgagccaggccaaatctaccaaggcgacctaaattaataaggttttcaaccgggacgtcgggggtcccagacagacttcgagcgcaagtgcgtcaggcactgatttcatactagaaaatcgagcgagggtgagctggagagttgttggggtttattacggtgtcgtaagtgacaaggcacacgtacgtggtccgtttcgtcgttcggggcccttggggacgaggtagtgggaattnttacgaattaacgaacgtggtgggacttggaactaacc

SEQ ID NO: 304511 - DNA, 637 bp, Homo sapiens
  misc_feature: GZ8MTXP01EQT3C.25.15.B04.1.454.CMB.2.raw
  modified_base (624)..(624): a, c, t, g, unknown or other
  misc_feature (624)..(624): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacacgccgcctcatctcctgcaagtctagtacaaagcctcgtctacattgaacgaacacctactgctattcggtccagcgtgacggccaggacccaaatcctaccgaaggccgtaaccttaaatttaaagttaacgggttttaccggtaaacccggggtaccgttccggggggtacccaaggacgtacgacgttacgaggcgggtacaaggtgcgtacgacggactacgtagtactttcaactacgtaagaaaactcgaggacgaggggttagggaggtgtagggaggtagttgggtttaggggttttaattacggtagtcgtaagtcggaacgaaacggtccaacgtacggtcgtccggttccgtttcggtcggtttcgggccgttggggacgttaggagtggattcgttacgaagtacgaagttggnggctcgctaaccg

SEQ ID NO: 304512 - DNA, 611 bp, Homo sapiens
  misc_feature: GZ8MTXP01EEB5Q.25.15.B04.1.454.CMB.2.raw
  modified_base (418)..(418): a, c, t, g, unknown or other
  misc_feature (418)..(418): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttgacacgccgcctccatctcctgctaagtctagtcaaacgcctcgtctacattacgaacgaacacctactgctattcgtcagctgacggccaggccaatcctaccgaaggcgtaacttaaatttaagttaacggtttacgtaaccgggacgtccgggggtaccagacagatcagcgcaagtgcgtgaggctactagtacttacgacaactagaaaactcgaacggngaaggggtacggaggtcgtagggaggtagttgggtttagggtttactacggtggactagtcgacgaaggcctacgaaccgtcgttcggttcccgtttcggcgtttcggggacccgttggggtaaccgttagacggttaaggttacttagttacgtaaagtacgtaacgttgggcggacttcggaactaacccg

SEQ ID NO: 304513 - DNA, 565 bp, Homo sapiens
  misc_feature: GZ8MTXP01B9MA2.25.15.B04.1.454.CMB.2.raw
  modified_base (407)..(407): a, c, t, g, unknown or other
  misc_feature (407)..(407): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatcctcctgcaagtctagtcaaagcctcgtctacattgaacggaaacacctactgctatgttccagctgaggccagcaatctcaagctacctaattaagtaacggtttcaaccgggtacgtcgggggtccagacacgattcgagcgcaagtgcgtcgaggcactgtacttcacactagaaatcgagcgagggtggagngtaggagtagtggtttagggttatacgtgcagtcgacaaggcaactacctacgtcggttccgtttcggtcgttttcgggcccgttaggggacgttaggtaggtggaacttacgacgtaacgtaacgtaacgttggtcggttacgtcgaacgtaacccg

SEQ ID NO: 304514 - DNA, 951 bp, Homo sapiens
  misc_feature: GZ8MTXP01DZYKI.25.15.B04.1.454.CMB.2.raw
  modified_base (198)..(198): a, c, t, g, unknown or other
  misc_feature (198)..(198): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtcaccttgacngccgcctcatctctgactaagtctagtacaaacgtcctcgtactactattaggaaccgaaacacctactgctagttcgtccagctggacggccgacggacctaatcctaccgaacggtaccgtaaccttaaagtttaaacgtttaacgggttttacccggtaaaccgggggtaccggttacccgggggtacccaacggtaaccgtaacggtacttcgaacggccgggtacgtaaacgggttcgtccggtacgacgggtacctaaccgttaggttaacttttaccgaaacccttaacgttaaagtaaaaaccgttccggtaaacgggaccggggttaaaggggggttacggggaacggggttacgttaagggggtaaagggggtttaacgggttttaggggggtttttaacgggggtttttaaacttttaaaccgggggttcggggttaacccgtttaaagggtaacgggtaaacccggggtaaaacccggggtaccccgaaaaccttaaacccgggttacccggggtttcccgggtttttacccccgggtttttaccccgggggtttcccgggggtttttaaaccccggggggccccggtttaaacggggggtaaacggggttaacggggttaaacgggttaagggggttaaaaccgtttaaccggttaaacccggttaaacggttaaaacccgggttaacccgggtttagggggcccggttaaacggtttccccggaaccgtttaaaccccg

SEQ ID NO: 304515 - DNA, 632 bp, Homo sapiens
  misc_feature: GZ8MTXP01AUMJK.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctccccctctcccctctccgtcacccttggacacgccgcctccatcctcctgcaagtctagtacaaagcccttgtctacattgaacggaaacacctactgctattcggttccagctggacggccaggcccaaatcctaccgaaggccgtaccttaaatttaagtaacgggtttccgtaaacccgggggacgttccgggggtacccaaggactagacttacgaggtccggctaagggtcgccgtcgaacgggcaccgtgtactttacaacacttaagaaaactcgaaggcggaggggtagggacggacgttaggaggtagttgggtttagggggttttaattacgggtgtacgtagtcgacgaacggcaccgactacgttccggtccgtttcgcggtttcgggcccggttgggacgaggtagtggattcgttacgaagtacgtaagtcggtggctcgccgtaacc

SEQ ID NO: 304516 - DNA, 572 bp, Homo sapiens
  misc_feature: GZ8MTXP01DQXMJ.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacagccggctccatctcctgcaagtctagtcaaagcctcgtctacattgacgaaacacctactgcattggttccagctgaggccaggccaaatctccaaggacgtacctaaattaataaggttttcgtaaccgggactcgggggtcccagacagattcagcgcaaggttgcgtcaaggcactgtactttcacactagaaaatcacgtgaggggtaggaggtcgtagaggtagttgttaggggtttattacggtgctatgcaaggctacaactcgtggtcccttttcgtccggttttgggccccgttaggggaccgttaggtaggtggttaagttattccgaattaccggaagtttggcgggttcttcggcgtaacccg

SEQ ID NO: 304517 - DNA, 717 bp, Homo sapiens
  misc_feature: GZ8MTXP01DBAZA.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacagccgctccatctcctgcaagtctagtcaaagtcctgtctacattgacgaacactactgcattggtccagctgaggcaggccaatctaccgaaggcgtacctaaattaagtaacggttttcgaaccggggtacgtccgggggtacccagaccgagattcgagccggcaaaggtcgcgtacgacgggtaccacgtgtactttacaaactaccgttaagaaaaacgttcgaaggtaccgtaagggggttagggaagggtcgttagggaagggttaacgttggggttttaagggggtttttaacttaaccgggtttaggaccgttaagttacggtaccgaaagggtcccaactaaccgtaacggttccgggttacccgttttccgggtccggtttttaaccgggggaccccgtttagggggaaaccggttaaggtaacgggttacgggttaaacgttattaacgtaacggttaaccgtaaaccgttgggtacgggttcgtttaacggaaccgtttaaaccccg

SEQ ID NO: 304518 - DNA, 802 bp, Homo sapiens
  misc_feature: GZ8MTXP01BABGM.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacacgccggcctccatctcctgacaagtctagtacaaacgtccctcgtctacagttagaaccggaaacacctacctgctagttcggtccagctgacggccaggaccaatcctaccgaaacggccgtacccttaaatttaaacgttaaacgggtttttacccgtaaacccgggggtacgttacccgggggggttaccccaaggaacccgtaaggtaactttcgaaacgggtccggggaccgtaaaacgggttccggccgggttccgaaacgggggtaccctaaccgtttacggtaacctttttaccaaaccgtaacccgttaaggaaaaaaacgttcccggaaggggtaccggggggtaggggtaaccggggtacgggttaggtaaggggttaaacgttggggtttagggggttttaagtttaccgttaggggtacgtaagttacgacgaaacgggaccaacgtaccgtaacgtcggttcccggtttcgttcccgggtttcgggtaaccccggttggggaaccgggtaagttagggtagggtaattacggttacttaacggtaacggtaacggtcggttggtccgttacgccgttaaccgttaaccg

SEQ ID NO: 304519 - DNA, 639 bp, Homo sapiens
  misc_feature: GZ8MTXP01B0CEU.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatctcctgcaagtctagtcaaagcctcgtctacattgacgaaacacctacctgctattggttccagctgaggccaggccaatcctccaaggcgtaccttaaattaacgtaacgggtttccgtaaaccggggaccgtccgggggtacccaggacacgtacttcgaggtcggcaagttcgccggtcacgggctactgtactttcgactactagaaatcgagcgagggtcggagcgtggaggtagttcgggtttagggtttacttaacggtggtacgtagttcggacgaacggcctaactaaccgtccgttcgggttcccgtttcggtccggtttaacggggcccgttgggggaaccgttaggtacggtagggttaacttcgttacgtaacgttacccgtaacgttgggtacgggcttaacggcccgttaaccg

SEQ ID NO: 304520 - DNA, 628 bp, Homo sapiens
  misc_feature: GZ8MTXP01CG39P.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaacacctacctgcattggttccagctgaggccaggccaatcctaccgaaggaccgtaccttaaatttaaacgttaacggttttacgtaaacccgggggtacgttccgggggttaccccaggacaacggtactttcgagtcggcgaaggtcgcgtcgacgggctacgtagtactttacgactactagaaaactcgaggacgaggggtggaggcgtaggaggagttgggtttaggggtttaattacggtgtacgtagtagcgaacggcaacgaccgtacgttcggtcctttcggtacggtttccggggtcccgttggggaccgttaggtaggtgggttattacgttactaagtacgtaacgtggtggactcgcttaacccg

SEQ ID NO: 304521 - DNA, 515 bp, Homo sapiens
  misc_feature: GZ8MTXP01B3U2Z.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgaggccaggccaatctccaaggcgccctaattaataaggtttctaaccgggactcgggggtcccagacagattcagcgcaagtgcgtcagggcactgatttcacactgaaaatcagcagggtggaggctgaggatggttggggtttattacgtgcatgcaaggcacacactggcctttcgctttgggccccttggggacgagagtgggattgttcaagtacgaactggtcgcgtgctaacc

SEQ ID NO: 304522 - DNA, 638 bp, Homo sapiens
  misc_feature: GZ8MTXP01B7JJS.25.15.B04.1.454.CMB.2.raw
  modified_base (479)..(479): a, c, t, g, unknown or other
  misc_feature (479)..(479): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtcacccttggacacgccgcctccatctcctgcaagtctagtcaaacgcctgtactacattgaacgaaacacctactgctattggtccagctgacggccaggccatctacaaggcctactaaattaagtaacgtttacgtaaccgggtacgtccgggggtaccagacgtagtacttcgaggcgcaaaggtgccgtacgagggcctacgtgtactttcgaactacgtagaaactcgaggtacgagggtaggaggtctagggagttagttagggtttaggggtttaacttacggnggtacgtaagtcggacgaaacggcctacgtaaccgtacgtccggttacccgtttcggtcggtttaaccggggcccgttagggggtacgttaggtacggttacgttagttacgttacgtaagtacggtaacgttggtcggttcgtcgaaccgttaacccg

SEQ ID NO: 304523 - DNA, 675 bp, Homo sapiens
  misc_feature: GZ8MTXP01DPNQS.25.15.B04.1.454.CMB.2.raw
  modified_base (262)..(262): a, c, t, g, unknown or other
  misc_feature (262)..(262): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtcaccgttggacacgccgctccatctcctgacagtctagtacaacgcctgtctacattagaacgaacacctaccngctattgttcagctgacgccacggaccaaactcctaccgaacggaccgtaaccttaaagtttaaacgttaacgggttttaccgaaacccgggggtacgttccgggggtacccaagaccgtaagtacttacgaaggccggactaaaggtcgccggtacaacgggtcctaacgttgtactttacaaactaacgttaagaaaacgtcgaaggacggtagggtagggagtcgtagggtaggttaagttgggtttagggtttaatacggtgtacgtagtacgaccgaaggccgaactaccgtacgttcgtccccgtttcggtcggtttcggggacccgttaggggtacgaggtaggtcggttaattcgttacgtaacgtaaacggtccgttggtaggcccttaaggaaccgttaaccg

SEQ ID NO: 304524 - DNA, 617 bp, Homo sapiens
  misc_feature: GZ8MTXP01CQB46.25.15.B04.1.454.CMB.2.raw
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
  modified_base (526)..(526): a, c, t, g, unknown or other
  misc_feature (526)..(526): n is a, c, g, or t
  modified_base (561)..(561): a, c, t, g, unknown or other
  misc_feature (561)..(561): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggaccagccggcctccatctcctgcaagtctagtcaaagcctcgtctacattcgacggaaactacctactgctattcggttccagctggacggccaggccaatcctaccgaaggccgtacttaattaagtaacgggtttacgaaccgggtacgtcggggtaccacgacgaccgtagtactcgacgcgtaacgtcgcgtacgacggcgtactagtcgttactacaacttagaaacgttaacnggacggtagggaggtacgggngtacggtagggtagttacggtttaggggtttagttacgtgtaccgtatacggacggtaacgcggtaaccncgtacgtcggtccgtttcgttcggtaacgggtcgngggtcggacgtaggcgttagttcttgtaactagtcgtaggtcgacgtcgcgtaacc

SEQ ID NO: 304525 - DNA, 704 bp, Homo sapiens
  misc_feature: GZ8MTXP01EVYV3.25.15.B04.1.454.CMB.2.raw
  modified_base (533)..(533): a, c, t, g, unknown or other
  misc_feature (533)..(533): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtccaccgttggacacgccgcctccatcctcctgactaagtctagtacaaacgtccctcgtctactattacgaacggaaactaccgtacctgactagttcggttccagcgtcggacggccgacggaccaactctaccgaagtaccgtaaccttaaagtttaacgttaacggtttaccggtaaccggggtacggtccgggggtacccaaggaacacggtacttcgaggcgacgtaacggtcgcgtacacgggctacgtgtacttcaactacgtaagaaactcgagtggaggggtaggacggtacgtaggagggttagttaggggttttaggggtttacttacgggggngtacgtagtacggaacgtaacgacctacgtaaccgtccggtttccggtttcccgtttccgggtccgggtttaaccggggtaccggttaggggtaacggttaaggtaggttaacgttacttacgttacgtaacgtacgtaagttcggacgttaccgtaaccgaaccgtaacg

SEQ ID NO: 304526 - DNA, 756 bp, Homo sapiens
  misc_feature: GZ8MTXP01ECRX8.25.15.B04.1.454.CMB.2.raw
  modified_base (261)..(261): a, c, t, g, unknown or other
  misc_feature (261)..(261): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctcccctctccgtcaccttgacagcccgcctccatctcctgctaagtctagtcaaacgtcctcgtctaactattgaaccggaaacnccctaacctgcagttcggttaccagcgtgacggccaggaccaaactcctacccgaaggccgtaacccgttaaaattttaaacgttaacgggttttaccgtaaacccgggggtaccggttccgggggttaccccaaagggacctacggtaacgttccggaaacggtccggggactaagggttcggtccggttaccgaacgggtaccctaacctttgggtaaaccttttcaaacctacgttaagaaaaacttccgaaggtaccggaagggggttgggtaaagggtcgtgggtaagggtagtttaggggtttagggggtttttaacttaccgggtaggtcgtaaacggttcggaacgaacgggacctaaccgtaaacgtcgtttcgggttaccctttcggttccggtttccggggtcccggttaggggtaaccggaggtaaggtcgttaagttacttccgaagtttacgaacgttgggtggacttcgaaccttaaccg

SEQ ID NO: 304527 - DNA, 724 bp, Homo sapiens
  misc_feature: GZ8MTXP01EBFPG.25.15.B04.1.454.CMB.2.raw
  modified_base (164)..(164): a, c, t, g, unknown or other
  misc_feature (164)..(164): n is a, c, g, or t
tcagactgtacagtcacgaccggtgctcgatttagacagtatatatccgcgggggactgatcaggactcctcagttcaccttctcacaatgaggctccctgctcagctcctgggctgctaatgctctgggtcccaggatccagtggtgatggttgtgctgactnagtctcccctctccctctccgtcaccttggacagccggcctccatctcctgcagtctagtacaaacgtcctacgtctaactacgttgaccggtaaaacaccctaacctggcctaattcggtttaccagctacggacggacccgaaggacccaatccctaccgtaaaggccgtaacttaaacgtttaaagtaaaccggttttacgtaaaccgggtacctccgggggtacccagaaccaggactttacgaacgcggctaaaggtcgtccgacgtagggaccctatacgggtaatttacgaaactactaaggaaaactaccgaacggagaaggttagggaacggtgtaggaggtagttaggtttagggtttaagtttaacgggttcggtactaacgttgacgaacgggacgtacgaaactaaccgttacggttcccgtttaccggttccggtttaaccgggttccgggtttccggggtaacggggttacggaaggttaacggttaacgttagttacgttaacgaaccggtaaacgtcgtaagggttctaacggccgtaacccg

SEQ ID NO: 304528 - DNA, 519 bp, Homo sapiens
  misc_feature: GZ8MTXP02IXDSR.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgaggccaggccaatctccaaggcgcctaattaataaggtttctaacgggactcggggtcccagacagattcagcggcagtgcgtcaggcactgatttcacactgaaaatcagcagggtgaggcgtgaggagtgttgggttagtttactgtcatgcgaaggacacacaactggtccgtttcgtcgtttcggtccgttcggacggagagtggagtattacaagtacgaacgtacgtgcgtcgacgac

SEQ ID NO: 304529 - DNA, 495 bp, Homo sapiens
  misc_feature: GZ8MTXP02IGMG6.25.15.B04.1.454.CMB.2.raw
  modified_base (475)..(475): a, c, t, g, unknown or other
  misc_feature (475)..(475): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctccctctccctctccgtcacccttggacagccggcctccatctcctgcaagtctagtcaaagcctcgtctacattgacggaaacacctacctgcattggttccagctgagccaggccaatctccaaggcgcctaattaataaggtttctaaccgggactcggggtcccagacagattcagcggcagtgcgtcaggcactgatttcacactgaaaatcagcagggtgagctgagatgttggggtttattacgtgcatgacaaggcacacacgtggcctttcgctttcgggccctgggacgagagtgatntcaatacgatgtgctagcac

SEQ ID NO: 304530 - DNA, 587 bp, Homo sapiens
  misc_feature: GZ8MTXP02HM7EI.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgagccaggccaatctccaaggcgcctaattaataaggtttctaaccgggactcggggtccagacacgatcagcggcagtgcgtcaggcactgatttcacactagaaaatcaagcgagggtgaggctagaggagttggtttaggggtttattacgtggtactagtggaccgaaaggcaacacgacgttcggtcccttttcggccgttttcggggccccgttgggggaaccgtaagggtacggttacggggaattaacgtaccgtaagttaacccggaaacgttggttacggggaccttcggaccgtaacccg

SEQ ID NO: 304531 - DNA, 548 bp, Homo sapiens
  misc_feature: GZ8MTXP02G557R.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgagccaggccaatctccaagcgcctaattaataaggtttctaaccgggactcggggtccagacagatcagcggcagtgcgtcaggcactgatttcacactgaaaatcagcagggtgaggctaggaggatggttagggttattacgtgtcatgacaaggcacacacgtggcctttcgcgtttcggggccccttgggggaccgtaggacggtacgggtaactagttaccgaagttaaccggaaacgttggtacgggtaccttggacctaacccg

SEQ ID NO: 304532 - DNA, 521 bp, Homo sapiens
  misc_feature: GZ8MTXP02I031W.25.15.B04.1.454.CMB.2.raw
  modified_base (351)..(351): a, c, t, g, unknown or other
  misc_feature (351)..(351): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgagccaggccaatctccaagcgcctaattaataaggtttctaaccggactcggggtccagacagatcagcggcagngcgtcaggcactgatttcacactgaaaatcagcagggtgagctgaggagtggtttaggggtttattacgtgctagtggacaaaggcaacacgtacgtggtcctttcgcgtttcgggccctgggacgaggacgtcggatagtacaagtacgaacgtgacggctcgactaac

SEQ ID NO: 304533 - DNA, 558 bp, Homo sapiens
  misc_feature: GZ8MTXP02IQXP8.25.15.B04.1.454.CMB.2.raw
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctcttggtcccaggatccagtggtgatgttgtgctgactcagtctcccctctccctcccgtcacccttggacacgccggcctccatctcctgcaagtctagtcaaagcctcgtctacattgacggaaacacctacctgcattgtcggctnagccagcanctcaagcgcctaattaataaggttctaacgggactcggggtccagacagatcagcgcagtgcgtnagggcactgatttccaacacttanaaaataccagacgaggggttaggaagggcgtaggaaggtagttagggtttacgggtttaattacgtgtacgtagtagacgaacggacaacgacgtacgtcggtcgttacgtcgttcggaccgtagggacgtaggacgtaggtactactacgtaagtacgtaagtggtacgctacgacaactactcg

SEQ ID NO: 304534 - DNA, 501 bp, Homo sapiens
  misc_feature: GZ8MTXP02G7N89.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggcgcctaattaataaggtttctaaccgggactcggggtcccagacacgattcagcggcagtgcgtcaggcactgatttcacactgaaaatcagcagggtgaggctgagatgttggggttatactgcatgacaaggcacgacactggcctttgcgtttcgggccctgggacgagagtggatagtcaagtacgaactgtggctgcac

SEQ ID NO: 304535 - DNA, 530 bp, Homo sapiens
  misc_feature: GZ8MTXP02I6R2L.25.15.B04.1.454.CMB.2.raw
  modified_base (289)..(289): a, c, t, g, unknown or other
  misc_feature (289)..(289): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggtccagctgagccaggccaatcncaagcgcctaattaataaggtttctaaccgggactcggggtcccagacagattcagcgcagtgcgtcaggcactgatttcacactagaaaatcagcaggggtggaggctgaggagttggttaggggtttattacgtggcagtgacaaggcacacacttggcctttcgcgtttcgggcccgttggggacgagtaggttggattagtcaacgttacgaaacttggtacggcttcggctaaccg

SEQ ID NO: 304536 - DNA, 497 bp, Homo sapiens
  misc_feature: GZ8MTXP02H3ZJ4.25.15.B04.1.454.CMB.2.raw
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggttccagctgaggccaggccaatctccaaggcgcctaaattaataaggtttctaaccgggactcggggtcccagacagattcagcgcagtgcgtcaggcactgatttcacactgaaaatcaagcagggtgaggctgaggatgttgggtttattactgnatgcaaggcacacacttggcctttgcctttgggccctggggacagagtggattncaatcgaactgtggctgcac

SEQ ID NO: 304537 - DNA, 496 bp, Homo sapiens
  misc_feature: GZ8MTXP02IMRGY.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggtccagctgagccaggccaatctcaagcgctaattataaggtttctaacggactcggggtccagacagatcagcgcagtgcgtcaggcactgatttcacactgaaatcagcagggtgaggctgagatgttggggttattactgcatgacaaggcacacacgtggcctttcgctttcgggcccttggggacgtagagtggatatcaagtaccgaactgtggctcgactac

SEQ ID NO: 304538 - DNA, 536 bp, Homo sapiens
  misc_feature: GZ8MTXP02IOZHC.25.15.B04.1.454.CMB.2.raw
  modified_base (526)..(526): a, c, t, g, unknown or other
  misc_feature (526)..(526): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctctgtcacccttggacagccggcctccatctcctgcaagtctagtcaaagcctcgtctacattgacggaaacacctacctgcattggttccagctgaggccaggctaatctccaaggcgacctaattaaataaggtttctaacccgggacgtccggggtcccagaccagattcagcgcagtgcgtcaggcactgatttcacactagaaaatcagcgagggtggaggctagaggattggttggggtttattacgtgacagtagacgaaggcacgacacgtggtcctttcgtcgtttcgggcccgtaggggaccgaggagtacggatagtcaagttaccgaactggnggcctgaccc

SEQ ID NO: 304539 - DNA, 565 bp, Homo sapiens
  misc_feature: GZ8MTXP02IO232.25.15.B04.1.454.CMB.2.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctccctctccctctccgtcacccttggacagccggcctccatctcctgcaagtctagtcaaagcctcgtctacattgacggaaacncctacngcatgtccagctgagcagcatcncagcnctaataatagttcaacggactcggggtccagacagattcagcggcagtgcgtcaggcactgatttcacactagaaaatcgagacgagggtggaggctggaggatgttacggggtttattacgtgcagtgacaaaggcaacgacacgtcggtcctttcgcgttttcggggccccgttcgggggaacgaagggtacggttacgggggaacttaaggttaccaaagttaaaccccggtaaaacgttacgggtaggggtcccttagggtacctaaaccccg

SEQ ID NO: 304540 - DNA, 521 bp, Homo sapiens
  misc_feature: GZ8MTXP02G4BNK.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcatggttccagctgagccaggccaatctccaaggcgacctaattaataaggtttctaaccgggactcggggtcccagacagattcagcgcagtgcgtcaggcactgatttcacactgaaaatcagcaggggtgaggctgaggatggttaggggtttattacgtgcgatgacaaaggcacacactggcctttcgcgtttcgggcccttgggaccgaggacgtggtatatacaagtacgaaacgtgtggctacggctaaccg

SEQ ID NO: 304541 - DNA, 498 bp, Homo sapiens
  misc_feature: GZ8MTXP02IPH3I.25.15.B04.1.454.CMB.2.raw
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggtccagctgagccaggccaatctccaagcgcctaattaataaggtttctaaccggactcggggtcccagacagatcagcgcagtgcgtcaggcactgatttcacactgaaaatcagcagggtgaggctgagatgttgggtttattactgcatgacaaggcacacactggtcctttcgctttcgggcccttgggacgtagagtggatntacaagtacgaactgngctgctac

SEQ ID NO: 304542 - DNA, 517 bp, Homo sapiens
  misc_feature: GZ8MTXP02H0JUV.25.15.B04.1.454.CMB.2.raw
  modified_base (401)..(401): a, c, t, g, unknown or other
  misc_feature (401)..(401): n is a, c, g, or t
  modified_base (506)..(506): a, c, t, g, unknown or other
  misc_feature (506)..(506): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagcccggcctccatctcctgcaagtctagtcaaagcctcgtctacattgacggaaacacctacctgcattggtccagctgagccaggccaatctccaagcgacctaattaataagtttctaaccggacgtcggggtccagacagatcagcgcagtgcgtcaggcactgatttcacactagaaaatcagcgaggtggagctgagngtgttagggtttatacgtgacagtgacgaaggcaacacacgttggtcctttcgcgtttcgggcccgttaggggacgaggacgtggatagtcaagtacgaacgtgnggctcgactac

SEQ ID NO: 304543 - DNA, 542 bp, Homo sapiens
  misc_feature: GZ8MTXP02H7TFO.25.15.B04.1.454.CMB.2.raw
  modified_base (251)..(251): a, c, t, g, unknown or other
  misc_feature (251)..(251): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctccctctccctctccgtcacccttggacagccggcctccatctcctgcaagtctagtcaaagcctcgtctacattgacgaaacncctactgcatggtccagctgagccaggccaatctccaaggcgcctaaattaataaggttctaaccgggactcggggtcccagacacgattcagcggcagtgcgtcgagcactgatttcacactagaaaatcagcagggtggaaggctaggaggtatggttgggggttttattaacgtggtcagtgacgaaggcacacacgttcggtcctttcggcgtttcgggcccgttggggaccgtaggagtcgggactagttacgaagttaccgaacgtcggtggccttaggcaaccg

SEQ ID NO: 304544 - DNA, 554 bp, Homo sapiens
  misc_feature: GZ8MTXP02IIFC9.25.15.B04.1.454.CMB.2.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagcccggcccccatctcctgcaagtctagtcaaagcctcgtctacattgacgaacacctactgcattgtccagctgaggcaggccaatctcaagcactaattaanagtttcaacggactcggggtccagacagactcagcgcagtgcgtcaggcacgtgatttcaacactagtaaaanacagagaggnggaggagtagaggtagttaggttagggtttagttagttagtagtagtagacgaagacgacgaacgacgtcgtccgttccgtcgttcggtccggtacggtacggacgtaggtacggtacgtacgtacgtaacgtaacgtaacgtacgtacgtacgtacgtacgtacgtacg

SEQ ID NO: 304545 - DNA, 511 bp, Homo sapiens
  misc_feature: GZ8MTXP02JYA7C.25.15.B04.1.454.CMB.2.raw
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgacggaaacacctacctgcattggttccagctgagccaggccaatctccaagcgacctaattaataaggtttctaaccgggactcggggtccagacacgatcagcgcagtgcgtcaggcactgatttcacactagaaaatcagcagggtgagctgagatggttagggtttatacgtgacatggacaagtgacacacacgtcggtcctttcgtcgtttcgggcccgtgggacgagtagtggatatcgaatacgactgtcggctcgacc

SEQ ID NO: 304546 - DNA, 594 bp, Homo sapiens
  misc_feature: GZ8MTXP02IW0VK.25.15.B04.1.454.CMB.2.raw
  modified_base (339)..(339): a, c, t, g, unknown or other
  misc_feature (339)..(339): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctgtctacattgacggaaacacctacctgcattgtccagctgagccagccaatctccaagcgctaattaataagtttcaaccggctcggggtccagacagatcagcgnagtgcgtcaggcactgatttcacactagaaaatcaagcgaggggtggaggcgtaggagggtagttgggttttagggggttttaatttacgtaggtcgtaagttcggacaaacgggccaacgaccgtaacgttcgggttacccgttttcggtaccggttttccggggcccgttagggggaccgtaagggtacggttcgggaattacgtacgtaagtaaccggtaaacgttggtcgggacctacggtacctaaaccg

SEQ ID NO: 304547 - DNA, 537 bp, Homo sapiens
  misc_feature: GZ8MTXP02GOQ9P.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggtccagctgaggccaggccaatctccaagcacctaattaataagttctaaccgggactcggggtccagacacgattcagcgcagtgcgtcaggcactgatttcacactagaaaatcagcgaggggtggaggctggaggagttggtttagggggtttattactgcaagtgacaaggcaacgacacgtggtccgtttcgcgtttcgggcccgttagggaccgaggtacgtggaagtatacaagtaccgaacgtcggtgtcgtacgactaaccg

SEQ ID NO: 304548 - DNA, 526 bp, Homo sapiens
  misc_feature: GZ8MTXP02HPWF9.25.15.B04.1.454.CMB.2.raw
  modified_base (354)..(354): a, c, t, g, unknown or other
  misc_feature (354)..(354): n is a, c, g, or t
  modified_base (440)..(440): a, c, t, g, unknown or other
  misc_feature (440)..(440): n is a, c, g, or t
  modified_base (517)..(517): a, c, t, g, unknown or other
  misc_feature (517)..(517): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggcgacctaaattaataaggtttctaaccgggactcggggtcccagacagatcagcgnagtgcgtcaggcactgactttcacactagaaaatcagcgaggggtggaggctggaggtagtggtttagggggttttattactggtnagttgacaaggcacactacgtggtcctttcgcgtttcgggcccgttgggacgagagtggatatcaagtacgaactgnggctgacac

SEQ ID NO: 304549 - DNA, 486 bp, Homo sapiens
  misc_feature: GZ8MTXP02JY13X.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgagccaggccaatctcagcgctaatatagttcacggatcggggtccagacagattcagcgcagtgcgtcaggcactgatttcacactgaaaatcagcagggtgaggctgagatgttggggttatactgcatgcaaggcacacactggtctttcgcgtttcgggcccgtgggacgagagtggatagtcaagtacgaactgtggctcgcacc

SEQ ID NO: 304550 - DNA, 597 bp, Homo sapiens
  misc_feature: GZ8MTXP02H7T3B.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagcccggcctccatctcctgcaagtctagtcaaagcctcgtctacattgacggaaacacctacctgctattcggttccagctgaggccaggccaatctccaaggcgacctaaattaataaggtttacgtaaccgggacgtcggggtcccagacagatcgagcgcagtgcgtcaggcatgtacttcacactagaaatcgagcgaggggtgaggcgtaggaggtagttagggtttaggggtttattacgtgactagtcggacgaaggaccacgtacgtacgttcggtcccgtttcggtccggttttcggggcccggttaggggaaccgtaggtacggttaggaactttacgtacgtaacgtaaccggtaacgttgggtacggtcctacggtaccctaaccg

SEQ ID NO: 304551 - DNA, 532 bp, Homo sapiens
  misc_feature: GZ8MTXP02F7K9P.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaaggcgacctaattaataaggtttctaaccgggacgtcggggtcccagacacgatcagcgcagtgcgtcaggcactgtatttcacactagaaaatcagcgagggtggaggctaggaggtagtggttggggtttaatacgtgctagtgacaaggcacacgtacgtggcctttcgcgtttcgggccctgggacgagtagtcggactagtacaagtacgaacgtggtcggtctcgacaccg

SEQ ID NO: 304552 - DNA, 559 bp, Homo sapiens
  misc_feature: GZ8MTXP02GEQNV.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctactgcattggtccagctgagccaggccaatctcaagcgacctaattaataaggttctaaccgggactcggggtccagacagatcagcggcagtgcgtcaggcactgatttcacactagaaaatcagcgaagggtgaggctggagatggtttaggggttattacgtgcagtgacaaaggcaacgactaacgtcggtcctttcggccgttttcggggcccccgttagggggaccgtaaggtacggtcggggaaacttagttaccaagtaacgaaacgttcggtagggccttcggactaaacccg

SEQ ID NO: 304553 - DNA, 585 bp, Homo sapiens
  misc_feature: GZ8MTXP02IDUNJ.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatcctcctgcaagtctagtacaaagctcgtctacattgacggaaacacctactgcattcggtccagctgacgccaggccaatcctaccgaaggccgtaccttaaattaaagttaacggtttacgtaaaccgggacgtccggggtaccaagacacgattcgagcggacaggtgccgtagaggctacgtgtattacacgactagaaaatcgagcgagggtgagctaggaggtagttgggttagggtttataacgtgacgtagtaggacaaggacaacgacgtacgtcggttcctttcggtcgtttcggggcccgttaggggacctaggacggttaggacttatcgaagtaacgaacgtggacggtctacgacctaccg

SEQ ID NO: 304554 - DNA, 564 bp, Homo sapiens
  misc_feature: GZ8MTXP02G8T4O.25.15.B04.1.454.CMB.2.raw
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggttatgttgtgctgactcagtctcccctctccctctccgtcacccttggacagccggcctccatctcctgcaagtctagtcaaagcctcgtctacattgacggaaacacctacctgcatggttccagctgaggccaggccaatctccagcgacctaattaataaggtttctaaccgggactcggggtcccagacagacttcagcggcagtgcgtcaggcactgatttcanactagaaaatcgancgagggtgagctgaggtagtgttggggtttaatacgtgctagtcgacgaaggcacactagtcggtcctttcggtccgtttcggggccccgttagggggaccgtaaggtaggtcgggtaactataccgtaaagtaacgtaaaccgtggtcgggtacctggtacccaaacgttacg

SEQ ID NO: 304555 - DNA, 532 bp, Homo sapiens
  misc_feature: GZ8MTXP02IYBI3.25.15.B04.1.454.CMB.2.raw
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagcccggcctccatctcctgcaagtctagtcaaagcctgtctacattgacggaaacacctacctgcattggtccagctgaggccaggccaaatctaccaaggcgacctaaattaaataaggtttactaaccgggacgtcggggtcccagacagattcagcggcagtgcgtcaggcactgactttcacactagaaaatcagcgagggtggaggctagaggattggttaggggtttatacgtgcagtgacgaaggcacacgtacgtggtccttcgtcgtttcggcccgtagggacgtagagtggatanacaagtaacgagtcgnggctcgactacg

SEQ ID NO: 304556 - DNA, 620 bp, Homo sapiens
  misc_feature: GZ8MTXP02GGTG6.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacgaaacacctacctgcattggtccagctgaggccaggccaatctaccaaggcgacctaaattaataaggtttacgtaaccgggactcggggtccagacagatcagcgcagtgcgtcaggcacgtgatttcacactagaaaatcgagcgagggtagaggctaggagtagttgggtttaggggttttaattacgtgtacgtagttacggacgaaacgggcaactaacgtaaccgttcgggtcccgttttcggtaccggtttttccgggggaccccgtttagggggaaccggtaaacgggtacggttacggggtaaacttagttaacgaacgttaaacccggtaaacgttggtacgggtacttcggaccgtaaacccg

SEQ ID NO: 304557 - DNA, 561 bp, Homo sapiens
  misc_feature: GZ8MTXP02IRJHA.25.15.B04.1.454.CMB.2.raw
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcaccttggacagcccggcctccatcctcctgacaagtctagtacaaagcctcgtctacattgacgaaacacctacngcatggtcanctgacgcaggccatcacagcactaataatagttcgtaacggcgtcggggtccagacagatcagcgnagtgcgtcgaggcactgtactttcaacactaagaaaatcagcgaggggtgaggntagaggtagttggtttacgggtttatcgtagcagttgagaacggcaacggactacggtcgttcccgtttacggcggttttcggggacccgttagggggacgtaaggtagggtacggaatttacgaccgtaaagtaacccgtaaacgttggcggtctacggacctaaacg

SEQ ID NO: 304558 - DNA, 502 bp, Homo sapiens
  misc_feature: GZ8MTXP02JFA17.25.15.B04.1.454.CMB.2.raw
  modified_base (424)..(424): a, c, t, g, unknown or other
  misc_feature (424)..(424): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaatctccaagcgctaatatagtttcaaccggactcggggtccagacagattcagcggcagtgcgtcaggcactgatttcacactgaaaatcaagcagggtgaggctgagatgttaggggtttattacgtgcagtganaaaggcacacgacttggcctttcgctttcgggccctggggacgaggacgtggatagtcaagtacgaactgtgctgcac

SEQ ID NO: 304559 - DNA, 553 bp, Homo sapiens
  misc_feature: GZ8MTXP02HTN1U.25.15.B04.1.454.CMB.2.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacgaaacacctaccngcatgtcagctgagcagccaatcnccaagcactaattaataagtttctaaccggacgtcggggtccagacagatcagcgnagtgcgtcaggcactgatttcacactagaaaatcagcgagggtgagngtgaggtattggttaggggtttatacgtgcgatggacaaggcaacaacgtcgtcggtccctttcggcgttttcggggacccgttagggggaaccgtaggtaaggttacggagttaacttaccgaaaagtaccggtaaacgtaggttacggccgtcgtaccgtaaccg

SEQ ID NO: 304560 - DNA, 510 bp, Homo sapiens
  misc_feature: GZ8MTXP02F90HM.25.15.B04.1.454.CMB.2.raw
  modified_base (413)..(413): a, c, t, g, unknown or other
  misc_feature (413)..(413): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaacacctacctgcatggtccagctgagcagcaatctcaagcgactaataataagttctaacggactcggggtccagacagatcagacgcagtgcgtcaggcactgatttcacactgaaaatcagcaggtgaggctgagagtgttaggggtttattaacgtgtanagtagagacgacacacgacgtcgtcgttcgtcgttcggtcgtacggacggagagtacgtagtatactaagtaacgtaacgtacgtgtcgtacgacac

SEQ ID NO: 304561 - DNA, 602 bp, Homo sapiens
  misc_feature: GZ8MTXP02ILSEY.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatcctcctgcaagtctagtcaaacgcctcgtctacattagaacggaaacacctactgctattggtccagctgacgccaggccaatctacaagcgactaaattaataaggtttcaaccggcgtccggggtccaagacagtattcgacgcggcagtcgcgtcaggaccactgtactttcacaactagaaaatcgaagcgaagggtaggaggtacgtaggaaggtagttagggtttagggggttttaattacggtagtactagttacgacgaaggacaacgactacgttcggttccgtttcgtcggtttcgggccgttaggggaacgtaggtacggtacggtaattactacgtaaacgtaccggtaaacgttgggtaacgtcgttacggactaaccg

SEQ ID NO: 304562 - DNA, 493 bp, Homo sapiens
  misc_feature: GZ8MTXP02FOWIU.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggtccagctgagccaggccaatctcaaggcgcctaattaataagttctaaccgggactcggggtccagacagattcagcgcagtgcgtcaggcactgatttcacactgaaaatcagcagggtgagctgagatgttgggttatactgcatgcaaggcacgactactggcctttcgctttgggccctgggacgagagtggatgtacaagtacgaactgtggctgcaccg

SEQ ID NO: 304563 - DNA, 546 bp, Homo sapiens
  misc_feature: GZ8MTXP02I6QEW.25.15.B04.1.454.CMB.2.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctcatctcctgcaagtctagtcaaagcctcgtctacattgacgaaacacctactgcatgtcagctgagccagcatcncagcactaataatagttcaacggctcgggccagacagatcagcgnagtgcgtcaggcactgtactttcaactactagaaaatcgaagcgaggggtgaggcgtaggagtagttggtttagggtttattacgtgctaagtgaccgaaggcaacactacgtcgtcctttcgccgtttcgggcccgttaggggaaccgtaggtacggtacggtaattacgtacgtaacgtaaccggtaacgttcggtacggtccttacggacctaaccg

SEQ ID NO: 304564 - DNA, 556 bp, Homo sapiens
  misc_feature: GZ8MTXP02F8QPI.25.15.B04.1.454.CMB.2.raw
  modified_base (355)..(355): a, c, t, g, unknown or other
  misc_feature (355)..(355): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctccctctccctctccgtcacccttggacagccggcctccatctcctgcaagtctagtcaaagcctcgtctacattgacgaacacctacctgcattggttccagctgaggccaggccaatctaccaaggccgacctaattaataaggtttacgtaaccgggacgtcggggtccagacagattcagcgnagtgcgtcaggcactgtatttcacactagaaaactcgaagtcgaaggggtggaaggctaggaggtagttggtttaggggtttattacgtgtacagtagacgaaaggcaacgactacgtcggtcctttcggtctttcgggacccgttggggacgagtacggtcgaactagtcaagtacgaacgttgcggtctacgacaaccg

SEQ ID NO: 304565 - DNA, 595 bp, Homo sapiens
  misc_feature: GZ8MTXP02ICMX7.25.15.B04.1.454.CMB.2.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgaacggaaacacctacctgcattggtccagctgagccaggccaatctcaagcgctaataatagtttcaacggacgtcggggtccagacacgtatcgagcgcagtcgcgtcgaggcactgactttacacactagaaaatcagcgagggtggaggtntggaggtntaggtttaggggtttattaacgtgngtagtgacgaaggcaacgacgtacgtgggttccctttcggtccgtttttcgggggccccgtttgggggaaaccgttaaacggggacggttacgggagtttaaacgtacctaaaaggttaacccgtaaaacggttcggtacgggtacttcggaaccgtaacccg

SEQ ID NO: 304566 - DNA, 679 bp, Homo sapiens
  misc_feature: GZ8MTXP02F4AMZ.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacagccggcctccatcctctgcaagtctagtcaaacgtcctcgtctacattgaacggaaacacctacctgctattcggttccagctggaggccaggccaatcctaccgaaggccgaccttaaaagtttaaacgttaaacgggtttaccgtaaaccggggtaccgtaccgggggtacccaaaggtaaccacgtattccgaaggccggacaaggtcgccggtacgacgggacctacgttacggtaacttttaccgaaactaaccgtaaaggaaaaacttccgaagacgtagggggtaggaacggtcgtaggagggtagttgggtttagggggtttaaacttacgttagtactaagttacggaacgtaaacgggcaacgtacgtaacgtcggttcctttcggtcgtttacggggcccgtaggggaacgaggtacggttaggaacttctacgaagtaacggtaacgtcggtcgtctacggactaaccg

SEQ ID NO: 304567 - DNA, 584 bp, Homo sapiens
  misc_feature: GZ8MTXP02J0B00.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggtccagctgaggccaggccaatctccaaggcgacctaattaataaggtttcgtaaccgggactcggggtcccagacagattcagcggcagtgcgtcaggcactgatttacacactagaaaatcagcgagggtggaggctagaggtattggtttcgggggtttattacgtggctagtcgagaaggcaacacctaacgtccgggtcctttcggtcgttttcggggcccgttagggggaccgtaaggtacgggtggtaacgtacgttaccgtaagttaaaccggtaacgttacggtcggtccgttacggacctaaacccg

SEQ ID NO: 304568 - DNA, 530 bp, Homo sapiens
  misc_feature: GZ8MTXP02GYBHS.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgacggaaacacctacctgcattggttccagctgagccaggccaatctcaagcgacctaataatagttctaaccggacgtcggggtccagacagattcagcgcagtgcgtcaggcactgtatttcacactagaaaatcaagcgaggggtaggaggcgtaggaggtagtgggtttaggggtttattaacgtgactagttggacaagtgactacactacgtcgtccttcgtcgttcggcccgttgggacgagtaggtggatagtcgagtacgaacgtgtacgctgacc

SEQ ID NO: 304569 - DNA, 602 bp, Homo sapiens
  misc_feature: GZ8MTXP02FVRYG.25.15.B04.1.454.CMB.2.raw
  modified_base (586)..(586): a, c, t, g, unknown or other
  misc_feature (586)..(586): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttgacagccgcctcatctctgcaagtctagtcaaagtcctcgtctactattagaacggaaacacctacctgctattggttccagctgacggccaggaccaatcctaccgaaggccgaccttaaattaaacgttaaacggtttaccgtaaccggggtacgtccgggggtacccaagaccgagtacttcgacgcggacaggtcgcgtacaggcacgtgtattcaacactagaaaatcgagtacggaggggtaggaggtacgtagggaaggtaagtttggggtttaggggttttaacttacgtgacgtagtagacgaaacggcaacgactacgtcgtccgtttcgcgtttcgggccgtaggacggagtaggtcgaatatacaagtaacgagttcggngtacgtcgactaaccg

SEQ ID NO: 304570 - DNA, 527 bp, Homo sapiens
  misc_feature: GZ8MTXP02J2NV7.25.15.B04.1.454.CMB.2.raw
  modified_base (255)..(255): a, c, t, g, unknown or other
  misc_feature (255)..(255): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatcctcctgcaagtctagtcaaagcctcgtctacattgacggaaacncctacctgcattgttcccagctgaggccaggtccaaatcaccaggcgacctaattaactaaggtttcaaccgggactccggggtcccacgacagacttnacgcgcagngtcgcaggcactgatttcacactagaaaatcgagacgaggtggaggngngagtgtgttggttagttagtgtgagagagagacacactcgtcgtcgttcgtcgttcggtccgcggacgagtacgtgacgtactacaacgtacgtacgtcgtcgtcgtcgactacg

SEQ ID NO: 304571 - DNA, 550 bp, Homo sapiens
  misc_feature: GZ8MTXP02GAFWH.25.15.B04.1.454.CMB.2.raw
  modified_base (356)..(356): a, c, t, g, unknown or other
  misc_feature (356)..(356): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatcctcctgcaagtctagtcaaagcctcgtctacattgaacggaaacacctacctgcattggttccagctgagcagccaatctccaagcgacctaattaataaggttctaaccgggactcggggtccaagacagattcagcgcagtncgtcaggcactgattcacactagaaaatcaagcaggggtggaggcgtaggaggagttggtttaggggtttattagtggcagtgacgaaggcacactacgtcggtcctttcgcgtttcggggcccgttaggggaccgtaggtacggtaggtaactataccgaagtaccgaaacgttggtagcgtacgactaaccg

SEQ ID NO: 304572 - DNA, 594 bp, Homo sapiens
  misc_feature: GZ8MTXP02FVSED.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgaacggaaacaccctactgctagttcggttccagctggacggccaggccaaatcctacccaaaggccgtacccttaaaattaaagttaaaggtttaccgtaaaccggggtacgtccgggggtacccaaggaccagtattcgagcggcagtgcgtcaggcactgtattcacatagaaaatcgagcgagggtgagcgtaggagtagttggtttaggggtttatagtgcagtacgcgaaacggcaacacgtaacgttcggtaccctttcgtcggtttcgggaccccgttagggacgaaggtcggtagtacgtattaccgaagttaacgaagtcggtggactacggcctaacg

SEQ ID NO: 304573 - DNA, 565 bp, Homo sapiens
  misc_feature: GZ8MTXP02F8WHP.25.15.B04.1.454.CMB.2.raw
  modified_base (370)..(370): a, c, t, g, unknown or other
  misc_feature (370)..(370): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctccctctccctctccgtcaccttggacagccgcctcatctcctgcaagtctagtcaaagcctcgtctacattgacggaaacacctacctgcattggttccagctgagccaggccaatctcaagcgacctaattaataaggttctaaccgggactcggggtcccagacagattcagcgcagtgcgtcaggcactgatttcanactagaaaatcagcagggtgagctaggaggagttggtttagggggtttattacgtgctagtcgacgaaacggcaacgaccgtaacgtcggtcccgttttcggccgttttacggggccccgttaggggaacgtagggtacggtacgggtaatataccgtaagtaacgtaacgtggttacgacttcggacctaaccg

SEQ ID NO: 304574 - DNA, 503 bp, Homo sapiens
  misc_feature: GZ8MTXP02FH7YJ.25.15.B04.1.454.CMB.2.raw
  modified_base (348)..(348): a, c, t, g, unknown or other
  misc_feature (348)..(348): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgacggaaacacctacctgcattggttccagctgaggccaggccaatctccaagcgcctaattaataggttcaaccgggctcggggtccagacagatcagcggnagtgcgtcaggcactgatttcacactagaaaatcagcagggtgaggctgaggatgttggggtttatacgtgcatgacaaggcacacactggcctttcgcgtttcggccctgggacgagaggtgactatcaagtacgaacgtgtaggctcgcaacc

SEQ ID NO: 304575 - DNA, 510 bp, Homo sapiens
  misc_feature: GZ8MTXP02J0JXF.25.15.B04.1.454.CMB.2.raw
  modified_base (504)..(504): a, c, t, g, unknown or other
  misc_feature (504)..(504): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccaaatctccaaggcgacctaaattaaataagggtttctaaaccgggactcggggtcccagacagatcagcggcagtgcgtcaggcactgatttcacactagaaaatcagcagggtggaggctgaggatggttggggtttattactgcatgcaaggcaacacgactggtcctttgctttcgggccctgggacgagagtgatatcaagtacgaatgtgcncgacac

SEQ ID NO: 304576 - DNA, 622 bp, Homo sapiens
  misc_feature: GZ8MTXP02JZ9KT.25.15.B04.1.454.CMB.2.raw
  modified_base (261)..(261): a, c, t, g, unknown or other
  misc_feature (261)..(261): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatctcctgcaagtctagtcaaagcctcgtctacattgacggaacacctactnctattcggttccagctagacggccaggccaatcctaccgaaggccgtaccttaaattaaagttaacgggtttaccgtaaccggggacgtccgggggtacccaggacagacttcgaggccggacaggtcgcgtcgaggccacgtgtactttacactaacttaagaaaatccgaaggacgagggggtaggaggtcgtaggaggtagttgggtttaggggtttattacgtggacagtcggacgaaggcaacgacgtacgtcggttccgtttcgtcggtttcgggacccgttggggacgtacggagtaggtaactacgtacgtaacgttaacgaaccgttggttacggcttacggaccgtaaccg

SEQ ID NO: 304577 - DNA, 512 bp, Homo sapiens
  misc_feature: GZ8MTXP02ITFRO.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccatctccaagcgctaattataaggtttctacgggactcggggtcccagacagattcagcggcagtcgcgtcaggcactgatttcacactgaaaatcagcgaggtggaggctgaggatggttgggtttattatgctattgctaaggcacacactggtcctttcgcgtttcgggccctgggacgagagtgacgtactacaagtacgaacgtagtggactgactaaccg

SEQ ID NO: 304578 - DNA, 721 bp, Homo sapiens
  misc_feature: GZ8MTXP02I5QXB.25.15.B04.1.454.CMB.2.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacngccgctccatctcctgcaagtctagtacaaagcctcgtctacattgaacgaacacctacngcattggtccagctgacgccaggccaatcgtaccaaggccaccttaaagttaagtaaacgggttttccgaaaccggggtaccggtccgggggtaccccaaggaaccgaggtacttccgaaggcggacgtacggttgccggttacacgggcaaccgttgtactttaccactaaaccgttagtaaaaacgtccgaaagggccggaagggggttaaggccgggtagttacgggggtaaggtaaagggtttccgggttttaaggggggttttaaaacttaccggtcggtactaaggtttcgggaaaccgaaacgggtacctaacggaaactaccggtttcgggttacccgtttcgtccgggtttttaaaccgggggccccggttaacggggaacggtaggtacggtacggtaacttacgtaccgtaaagtaccgtaaacgtcggtggtaaccttcggaccgtaaccg

SEQ ID NO: 304579 - DNA, 615 bp, Homo sapiens
  misc_feature: GZ8MTXP02HQVZU.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctcccctctccgtcacccttggacagcccggcctccatcctcctgcaagtctagtcaaagcctcgtctacattgacggaaacacctacctgcattgttccagctgaggccaggccaaatctccaaggcgacctaattaataaggtttcaacgggactcggggtccagacagattcacgcggcagtgtcgtcacggtcacgtgacttttcaactactagaaaactcgaaagcgaggggtggaaggcgtaggaaggtagttcgggtttagggggttttaattaccgttagtctagttacggacgaaaacgggccaacacgtacgttcgggtcccttttcggtccgttttcgggaccccgttgggggaccgtacggtacggtcggtaagttacgtacgtaaagtacggtaaaccgttggtacgggtccttacggcctaaacccg

SEQ ID NO: 304580 - DNA, 508 bp, Homo sapiens
  misc_feature: GZ8MTXP02IRX15.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggttccagctgaggccaggccatctccaagcgcctaattataaggtttctaaccggactcggggtcccagacagattcagcggcagtgcgtcaggcactgatttcacactgaaaatcagcagggtggaggctgaggatggttggggtttattagtgcatgacaaggcacgacacgtggtcctttcgcgtttcgggcccttggggacgagagtgagtatcaagtacgaactcgtggctgctac

SEQ ID NO: 304581 - DNA, 520 bp, Homo sapiens
  misc_feature: GZ8MTXP02HN7YC.25.15.B04.1.454.CMB.2.raw
  modified_base (253)..(253): a, c, t, g, unknown or other
  misc_feature (253)..(253): n is a, c, g, or t
  modified_base (494)..(494): a, c, t, g, unknown or other
  misc_feature (494)..(494): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacgaaacncctactgcatggtccagctgagccaggccaatcacagcgactaataatagttactaacggcgtcggggtccagacacgattcagcggcaggtgcgtcaggcactgtatttcacactagaaaatcagcgagggtggaggctaggaggtagttggtttaggggtttattaacgtgtactagtcgaccgaaggcaacgactacgtcgtcctttcgcgtttcggcccgttggacgagacgtgatntacaagtacgaacgtgcgctcgacac

SEQ ID NO: 304582 - DNA, 548 bp, Homo sapiens
  misc_feature: GZ8MTXP02GR6H0.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatctcctgcaagtctagtcaaagcctgtctacattgacgaaacacctacctgcattggtccagctgagccaggccaaatctaccaaggcgacctaaattaaataaggtttacctaaccggggacgtcggggtccagacagattcagcgcagtgcgtcaggcactgatttcaacactagaaaatcagcgagggtgagctgagatggttagggttatactgacatgacaaggcacgactacgtcggtcctttgcgtttcggggacccgttaggggaccgaagtaacggtcggaaattactacgaaagttaaccgaaacgttgtacggacttcgacctaaccg

SEQ ID NO: 304583 - DNA, 691 bp, Homo sapiens
  misc_feature: GZ8MTXP02GD83S.25.15.B04.1.454.CMB.2.raw
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaacgcctcgtctactattagaacggaaacacctacctgctattggttccagctgacgccaggccaatctaccgaagccgacctaaattaataacggtttccgtaaccgggtctccggggtacccagacacgattcgagtcgnagttgcgtnaacggctacgtgtactttcaacacttaagaaaactcgaaggtacgaaggggttcggacgggtgtagggtagggtacgttggggttttacgggggtttaattaccggtggtacctaagttccggaacgaacgggacctaaccgtacgtaaaccgttccgggtaccctttttcgggtaccggttttaccgggggcccccgtttagggggacccgtaaaggggtcggttacgggtaattaacggtaccctaaaggtttaaaccccggtaacgtttgggttaaccggggcctttaacggggacccctttaaaaccgg

SEQ ID NO: 304584 - DNA, 621 bp, Homo sapiens
  misc_feature: GZ8MTXP02I7YQA.25.15.B04.1.454.CMB.2.raw
  modified_base (265)..(265): a, c, t, g, unknown or other
  misc_feature (265)..(265): n is a, c, g, or t
tcagactgtacagtcacgaccggtgctcgatttagacagtatatatacgcgggggactgatcaggactcttcagttcaccttctcacaatgaggctccctgctcagctcctggggctgctaatgctctgggtcccaggatccagtggtgatgttgtgctgactcagtcctcccctctccctctccgtcacccttggacagcccggcctccatcctcctgcaagtctagtcaaacgcctcgtctacattgacggaaacacctaccngcattggtccagctgaggcccaggccaatctaccaaggccacctaaattaagtaaacggtttcgtaaccgggacgtcggggtcccaagacacgattcgagcggcagtgcgtcaggctactgtactttcgactaacgtagaaaaatccgaaggcggaggggtaggacggcgtagggaggtagttggggttttaggggtttaattaacgtgacagttcgagaaaggctaacactacgttcggtccctttcgtcggttttacgggcccggttagggaaacggtaggtacggttaggaacttaacgtacgaaacggttaacggtaaaccgttgggtcggtacgttcggaaccctaacccg

SEQ ID NO: 304585 - DNA, 552 bp, Homo sapiens
  misc_feature: GZ8MTXP02FOCSZ.25.15.B04.1.454.CMB.2.raw
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacacgccggcctccatctcctgcaagtctagtcaaagcctcgtctacattgacggaacacctacctgcattggttccagctgaggccaggccaatctccaagcgacctaataataaggttctaaccgggacgtcggggtccagacagattcagcgcagtgcgtcaggcactgtactttcactatacgaaaatcaagcgaggggtaggaggngtagaggagtggttgggtttagttacgtgnagtagacgaacggcgacactacgtcgtccgtttcgtcgtttcggtccggtacgggacggaggtaggtacggtagtatacgtaacgtacgtaacgtacgtggtacgtcgtcgaaccg

SEQ ID NO: 304586 - DNA, 550 bp, Homo sapiens
  misc_feature: GZ8MTXP02JGJPN.25.15.B04.1.454.CMB.2.raw
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgaacgaaacacctactgctattggtccagctgaggccaggccaatctccaaggcgcctaaattataacggtttctaaccgggacgtcggggtcccagacagatcagcgnagngcgtnaggcactgtactttcacaactagaaaatcgagcgaggggtggaggctaggaggtagttggtttaggggtttattacgtgcagtgacaaggcacgacacgttcggtccgtttcgcgtttcggggacccgttggggacgtaggtacgtaggtatactacgaagtacgtaacgtggtcggactcgactaacg

SEQ ID NO: 304587 - DNA, 565 bp, Homo sapiens
  misc_feature: GZ8MTXP02JNYOD.25.15.B04.1.454.CMB.2.raw
  modified_base (472)..(472): a, c, t, g, unknown or other
  misc_feature (472)..(472): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattggtccagctgagccaggccaatctcaaggcgacctaattaatagtttcgtaaaccgggcgtccggggtcccagacacgattcagcggcaggtcgcggttcagggccacgtgtactttcactactagaaaaactcagcgaggggtggaggctaggaggtagttggtttaggggtttattacgtgtactagttcgacgaaggcacganacgtcgtaccgtttcgcgtttcgggcccgttgggaccgtaggacgtagggactagtacgaagtaccgaagttcggtagtctacggcctaaccg

SEQ ID NO: 304588 - DNA, 507 bp, Homo sapiens
  misc_feature: GZ8MTXP02FO10M.25.15.B04.1.454.CMB.2.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (384)..(384): a, c, t, g, unknown or other
  misc_feature (384)..(384): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccggcctccatcctcctgcaagtctagtcaaagcctcgtctacattgacggaaacacctactgcattggtccagctgagccagccaatcncagcnctaatatagttcacggctcggggccagacagatcagcggcagtgcgtcaggcactgatttcacactagaaaatcagcaggggtgacggntggaggattgggtttaggggtttattacgtgcatgacaaggcacacactggtcctttcggtcgtttcgggcccgtgggacgaggacggtggatatcaagtaacgacgtggtggctacgctaac

SEQ ID NO: 304589 - DNA, 587 bp, Homo sapiens
  misc_feature: GZ8MTXP02JGHHK.25.15.B04.1.454.CMB.2.raw
  modified_base (560)..(560): a, c, t, g, unknown or other
  misc_feature (560)..(560): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctcctcacccttggacagccggcctccatctcctgcaagtctagtcaagcctcgtctacattgaacgaaacacctacctgctattggtccagctaggagccaggccaatcctaccaaggccgtaccttaaattaacgtaacgggtttccgtaaccggggtaccgtcgggggtaccccagtaaccgagtacttacgacgcggacgtaggttgccgtcgagggcctactagtactttacacctaatagaaaactcgagtcggaaggggtgaggctaggaggagttcggtttaggggtttattacgtgactaagtgacaaggcacacgtcgtcgtcttcggtcgtttacgggcccgtaggggacgagtcgtacggatacganaagtaccaagtgtaggctgacgtaacc

SEQ ID NO: 304590 - DNA, 826 bp, Homo sapiens
  misc_feature: GZ8MTXP02HO3VW.25.15.B04.1.454.CMB.2.raw
  modified_base (252)..(252): a, c, t, g, unknown or other
  misc_feature (252)..(252): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttgacagccgcctcatcctctgcaagtctagcaaagcctcgtctacattgaaccggaaacncctacctgctattcggtccagctgacggccaggccaatctaccaaggccgaccttaaattaacgttaagggtttaccgtaaccggggtacggtccgggggtaccccaaggactacggtacttacgacggaccggctaacggttcgccgggttaccgaacggggtacctaccgtttacggtaacttttaccgaaaccctaaagtttaaacggaaaaacttacgaacgggacccgggtaagggggttacgggtaaacgggggtacggttaaggggtaaacggggtttaggttttacgggggttttttaaaggggtttttaaacgtttaccggttacggttaacgtaacggttacgggtaaaccggtaaacggaacccgtaaccgtaaccgttaccgggtttcccgggtttacccggttttacgggttaccccggggttttaccgggggtacccgggttaagggggtaaaccggtaagggttacggttacggttaaaacttaacggttaacggttaaaaccggttaacggttaacggttacgggtaccggtaacccgttacggtaaccctaaacccg

SEQ ID NO: 304591 - DNA, 585 bp, Homo sapiens
  misc_feature: GZ8MTXP02JO5GZ.25.15.B04.1.454.CMB.2.raw
tcagactgtacagtcacgaccggtgctcgatttagacagtatatatccgcgggggactgatcaggactcctcagttcaccttctcacaataaggctccctgctcagctcctggggctgctaatgctctgggtcccaggatccagtggtgatgttgtgctgactcagtcctcccctctccctctccgtcacccttggacacgccggcctccatctcctgcaagtctagtacaacgcctcgtctacattgaacgaaacacctactgcattggtccagctgacggccacggccaaactcctaccgaaggccgtacctaaaatttaaacgtaacggttttaccgaaacccggggtacgtccggggtacccagacagacttcgagcggcagtcgcgtgacggctactgtattcaactactagaaaatcgagcgaggggtggaggcgtaggtaggtacgttgggtttagggtttatacgtgactagtgacgaagccacgactacgtcggttcctttcggtcgttcgggtacccgtgggacgaggtagtggactacgtacaagtaacgtaacgtggtcgcgtcgacacttac

SEQ ID NO: 304592 - DNA, 586 bp, Homo sapiens
  misc_feature: GZ8MTXP02FHX51.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatctcctgcaagtctaagtcaaagcctcgtctacattgaacggaacacctacctgcattggttccagctgaggccaggccaatctccaggcgactaattaataaggttcaaccggggtacgtccgggggtccaggtacagacttcgacgcggcacgtggcgtcgacggcactgtactttcaactactagaaaaactcgaagtccggaagggggttgggaacgggtcgtaggaggggtacgttggggtttagggggtttattacgtgcgtatggacaagggtcaacacgacgtcggtcctttcgtcggtttcgggacccgttgggggacgtaggagtggtaatacgtacaagtaacgtaacgtggtcgcgtcgactacc

SEQ ID NO: 304593 - DNA, 573 bp, Homo sapiens
  misc_feature: GZ8MTXP02I9FKA.25.15.B04.1.454.CMB.2.raw
  modified_base (434)..(434): a, c, t, g, unknown or other
  misc_feature (434)..(434): n is a, c, g, or t
  modified_base (539)..(539): a, c, t, g, unknown or other
  misc_feature (539)..(539): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaacgcctcgtctacattgacggaacacctactgctattgttcagctgacggccaggccaatctaccgaaggccgaccttaaattaaagtaacggtttactaaccgggtaccgtccggggtaccagaccagacttcgagcggcagtcgcgtcacgggctaccgtgtactttaccgaactactagaaaactcgaagcgagggtggacggngtaggaggtagttggtttaggggtttattacgtgactagtgacgaacggcacgacgtacgtcgttccgttcgtcggttcgggccgtaggacgagtagtgtaactntacgaagtacgtaacgtggtcgtctacgctaacg

SEQ ID NO: 304594 - DNA, 676 bp, Homo sapiens
  misc_feature: GZ8MTXP02FN0G0.25.15.B04.1.454.CMB.2.raw
  modified_base (197)..(197): a, c, t, g, unknown or other
  misc_feature (197)..(197): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtcacctgacngccgcctccatctctgcaagtctagtacaaacgtcctcgtctactattacggaacgaaacacctacctgctagttcggtccagcgtggacggaccgaggaccaactcctaccgaaggtcctaccttaaaagttaaacgttaacggtttaccgtaaccggggtacgtaccggggtaccaagacgacgtatcgagcgacgagtcgcgtcgaggtactacgtgtaactttaccgaactaacgtaagaaaacgtcgaaggtcgggtaaggggtggacggtcgtagggtagggttagttcggggttttaaggggtttaattacggtgacgtagttacggaacgtaaacggtccaacgtaccgttacgttcggttcccgttttcggtccggtttaccggggcccgttaggggacgtaaggtacggtacggtaacttaacgtaccgaaagttaacggacgttggggtcgacgttacgacctaaccg

SEQ ID NO: 304595 - DNA, 495 bp, Homo sapiens
  misc_feature: GZ8MTXP02F8OZH.25.15.B04.1.454.CMB.2.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacagccgcctccatcctcctgcaagtctagtcaaagcctcgtctacattgaacgaaacacctactgctattggtccagctgaggccagcaaatcncaagcactaataataagttcaacggctcgggccagcagatcagcgcagtncgcaggtccangtattcaacataagaaaataanagagaggaggaggngagaggtagttagttaggttagtagtganatagagaacgacacacacgtcgtcgtcgtcgttcggtcgaggacgagagnganatanaagtacgacgtgngcncacac

SEQ ID NO: 304596 - DNA, 611 bp, Homo sapiens
  misc_feature: GZ8MTXP02FVAPW.25.15.B04.1.454.CMB.2.raw
  modified_base (199)..(199): a, c, t, g, unknown or other
  misc_feature (199)..(199): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacngccggcctccatcctcctgcaagtctagtacaaagcctcgtctacattgaacgaacacctacctgctattcggtccagctgacggccaggccaaatcctaccgaacggccgtaccttaaagttaaattaacgggtttaccgtaaaccggggtaccgtaccgggggtacccaagacacgtattcgagcggcagtcgcgtcgaggcactgtactttcactactagaaactcgaagcgtaggggtaggacggtcgtaggaaggtagttgggtttaggggtttaatacgtagactagtacggacaaacggcaacgacgtacgtcggtcctttcggtcgtttcgggcccgttagggacgaggtacgtaggtactagtaccgaagtaccggtaacgttggtcgtacgtcgactaaccg

SEQ ID NO: 304597 - DNA, 519 bp, Homo sapiens
  misc_feature: GZ8MTXP02GDD4J.25.15.B04.1.454.CMB.2.raw
  modified_base (394)..(394): a, c, t, g, unknown or other
  misc_feature (394)..(394): n is a, c, g, or t
  modified_base (495)..(495): a, c, t, g, unknown or other
  misc_feature (495)..(495): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgaacggaaacacctacctgcattggttccagctgaggccaggccaatctccaaggcgacctaaattaataaggtttctaaccgggactcggggtcccagacagatcagcggcagtgcgtcaggcactgatttcacactagaaaatcaganagggtgaggctgaggatgttaggggtttactaatgcatgacaaggacacacaactggtcgttcgtcgtttcggtccgtcggacgagagtaggtactattanaagtacgaacgtagtgcgcgacac

SEQ ID NO: 304598 - DNA, 478 bp, Homo sapiens
  misc_feature: GZ8MTXP02FY7IT.25.15.B04.1.454.CMB.2.raw
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
tcagactgtacagtcacgaccggtgctcgatttagacagtatatatccgcggggactgatcaggactcctcagttcaccttctcacaatgaggctccctgctcagctcctggggctgctaatgctctgggtcccaggatccagtggtgatgttgtgctgactcagtctccctctccctctccgtcacccttggacagccggctccatctcctgcaagtctagtcaaagcctcgtctacattgacgaaacacctacctgcattggtcagctgagcaggccaatctcaagcactaataataagttcaacgggactcggggtccagacagatcagcgcagtgcgtcaggcactgatttcacactagaaaatcagcgagggtgagntgagatggttgggttatacngnatgacaatgacacacactggtccttcgctttcgggccctgggacgngagtgntaancanacgactgcgctacnc

SEQ ID NO: 304599 - DNA, 581 bp, Homo sapiens
  misc_feature: GZ8MTXP02JDH3F.25.15.B04.1.454.CMB.2.raw
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcacccttggacacgccgcctccatcctcctgcaagtctagtacaaacgcctcgtctacattgaacgaaacacctactgcattcgttccagctgagccagccaatcncaagcactaataatagttcaacggcgtcggggtccagacagatcgagcgnagtgcgtcaggcacgtgtatttacgactaaacgtagaaaacgtcaaggcgtaagggggtggaggcgtaggaaggtagttgggttttacggggtttattacggtgtaccgagttggacaagggacaacctaacgtcgttcggttccgtttcgcggttttcgggacccgttaggggaccgtaggtacggtgtactacgtacgtaacgtacgtaacgtgggtacgacttcggacctaaccg

SEQ ID NO: 304600 - DNA, 504 bp, Homo sapiens
  misc_feature: GZ8MTXP02HZWH5.25.15.B04.1.454.CMB.2.raw
  modified_base (149)..(149): a, c, t, g, unknown or other
  misc_feature (149)..(149): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtnatgttgtgctgactcagtcctcccctctccctctccgtcacccttggacagccgcctcatcctctgcaagtctagtcaagcctcgtcacattgacgaacncctacngcatgtcagctgagcagcatcncagcgctaatatagtcgacggntcgggtcagcagatcagcgnagtgcgtnagcactgtcttacgacactagaaatcgacgngaggngagntagagtgttgttacgggtttatacgtgtatagtgactaggcactagtcgcgttcgttcgcggtttcggacccgttagggactaggtcgttaagatacctagaagtaaccggactttggcgtcgttcggtaaccctcg

SEQ ID NO: 304601 - DNA, 590 bp, Homo sapiens
  misc_feature: GZ8MTXP02F0KOG.25.15.B04.1.454.CMB.2.raw
tcagactgtacagtcacgaccggtgctcgatttagacagtatatatccgcgggggactgatcaggactcctcagttcaccttctcacaataaggctccctgctcagctcctggggctgctaatgctctgggtcccaggatccagtggtgatgttgtgctgactcagtcctcccctctccctctccgtcacccttggacagcccggcctccatcctcctgcaagtctagtcaaagcctcgtctacattgacggaaacacctacctgcattggtccagctgaggccaggccaatctccgaaggcgacctaaattaagtaaggtttaccgtaacccggggacgtccggggtaccccagacagtacttcgagcggcagtgcgtcgaggcacgtgatttacacactaagaaatcagcgagggtgaggctaggaggtagttaggttggggtttaattacgtggcagtcgacgaaggccacgacgtacgttcggtcccgtttcggtcgttccggggacccgttgggggaccgaggtaggttagggaacttacgactaagtaacgtaacgtgggtacggcgttacggacctacgtaac

SEQ ID NO: 304602 - DNA, 606 bp, Homo sapiens
  misc_feature: GZ8MTXP02JR2WW.25.15.B04.1.454.CMB.2.raw
  modified_base (259)..(259): a, c, t, g, unknown or other
  misc_feature (259)..(259): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctccctctccctctccgtcacccttggacagccgcctccatctcctgcaagtctagtcaaagtcctcgtctacattgacgaacacctactncatggtcagctgagccagccatctcagcactaatatagttctacggcgtcggggtccagacacgatcagcgcaggtcgcgtcgaggcacgtgtactttcacactaagaaaactcgagcgtaggggtacgaggtacgtaggaggtagtttaggggtttacggggtttacttaccgtggtacgtagtcggaacgaaccgggactaaaccgtacgtaacggttccggttacccgttttcgggtaccggtttcggggtccccggttaggggaaccggtaggtaacggtacggtaattacgtaacgtaagtaaacggtaacggttcggtacggtccgtacggaccgtaaccg

SEQ ID NO: 304603 - DNA, 562 bp, Homo sapiens
  misc_feature: GZ8MTXP02F85E8.25.15.B04.1.454.CMB.2.raw
  modified_base (254)..(254): a, c, t, g, unknown or other
  misc_feature (254)..(254): n is a, c, g, or t
tcagactgtacagtcacgaccggtgctcgatttagacagtatatatccgcgggggactgatcaggactcctcagttcaccttctcacaataaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacncctactgcatggtccagctgagccaggccaatctcaggcgcctaattaataaggtttctaaccgggacgtcggggtccagacagacttcagcggcagtcgcgtcgaggcactgatttcacactagaaaatcgagacgagggtgaggctaggaggtagttggttaggggtttattacgtggctagtggacgaaggccaacgtacacgtcggtcccgtttcgtccggtttcgggcccttaggggacggaggtacggtaggattacgtacctagtaaccgtacgtaggttcgggactcggaccaaccgttc

SEQ ID NO: 304604 - DNA, 551 bp, Homo sapiens
  misc_feature: GZ8MTXP02GR23V.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtctcccctctccctctccgtcacccttggacagccggcctccatctcctgcaagtctagtcaaagcctcgtctacattgacggaaacacctacctgcattgtccagctgagccagccaatcacagcgactaattaataaggtttcaaccggacgtcggggtccagacagattcagcgcagtgcgtcaggcactgatttcacactagaaaatcagcgagggtgaggcgtagagagttggtttagggggtttaattacgtgacgagttaggacgaaaggcaacacgtaacgtcggtccgtttcgcgtttcggggcccgttaggggaccgtaggtacggtcggaattagtacgaacgtaacggtaactggtacgcgtacgactaaccg

SEQ ID NO: 304605 - DNA, 589 bp, Homo sapiens
  misc_feature: GZ8MTXP02HQ0X5.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctccctctccctctccgtcaccttggacagccgctcatctcctgcaagtctagtcaaagcctcgtctacattgacggaaacacctacctgcattggtccagctgaggccaggccaaatcctaccaaggcgacctaaattaaataaggtttactaaccgggactccggggtcccaggacacgattcagcgcagtgcgtcaggcactgtattcacactagaaaatcagcgagggtgaggctggaaggtagttaggttggggtttaattacgtggacagtacgacgaaggccaacgacgacgtcgttccgtttcgtcggttttcgggcccccgttagggggaaccgaggtacggttacgggagttaactaccgtaaagttacccggtaaaacgtggttaccggcgttacggaccgttaaacccg

SEQ ID NO: 304606 - DNA, 808 bp, Homo sapiens
  misc_feature: GZ8MTXP02JYEQ5.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccgttgacacgccgcctcatcctcctgacaacgtctacgtacaacgtcctcgtactactagttacggaacggaaaacctacctaaccgtgtactacgttcgggttaccaaggtccgtaggaccggcccgaacggaccctaaactcccgtaaccgaacgggaccgtaaccgtttaaaagtttaaaacgttaaaccggggtttaaccgtaaacccggggtaccggttccggggggtaacccaaggtaccgaagtacgttaccgacgggtccggacgtaaggttcggtccggtacgaaacggggtaccctagttacgtaactttaaccaaacgtaaaccgtaagtaaaaacttcgaacggtaaggtagggggtagaaccggtggtaaggtaggtacgggtttaagggtttacggggttttaaagtcgtttacggaacgtagttaccgggactaaacgggaccgaaacttaaccggtccggtttaccgggttacccgttttcgggttaaccgggtttccgggggaccccgggttaggggaaaccggtaaggttacggtaacgggtaactacggttaacgaaccgtttacggaacggtcggtacggtactaccggtacctaacg

SEQ ID NO: 304607 - DNA, 609 bp, Homo sapiens
  misc_feature: GZ8MTXP02FKOQ5.25.15.B04.1.454.CMB.2.raw
  modified_base (455)..(455): a, c, t, g, unknown or other
  misc_feature (455)..(455): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagactgtacagtcacgaccggtgctcgatttagacagtatatatccgcgggggactgatcgggactcctcagttcaccttctcacaatgaggctccctgctcagctcctggggctgctaatgctctgggtcccaggatccagtggtgatgttgtgctgactcagtcctcccctctccctctccgtcacccttggacagcccggcctccatcctcctgcaagtctagtacaaacgcctcgtctacattgaacgaaaccacctacctgcattcggttccagctagacggccaggccaatccgtaccgaaggccgtacctaaaatttaaagttaacggtttaccgaaaccgggacggtccggggtacccagaacaggtaacttcgagcggacaggtcgcgtcgagggcacgtgtatttacactaactaagaaaatcgaagtcgaggggtcggaggntaggaggtagttaggggtttagggtttattacgtncgtatgggtanaacggctacactacgtcgtcctttcgtcgttcgggtccctagggggacgtaggtaggtacggtaatacgtactacgtaaacgaacgtcggtcgacgtcgaccaactcg

SEQ ID NO: 304608 - DNA, 690 bp, Homo sapiens
  misc_feature: GZ8MTXP02IA6VZ.25.15.B04.1.454.CMB.2.raw
  modified_base (261)..(261): a, c, t, g, unknown or other
  misc_feature (261)..(261): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcacgtcctcccctctccctctccgtcaccttggacacgccgcctcatctcctgcaagtcagtacaaacgcctcgtctacattgaacgaaacacctctnctattcgtcagctgacggccaggacctaaactccgtaccgaaacggtaccgtaaccctttaaaagtttaaaacgtttaaaccgggttttaaaccccggtaaacccggggtaccgggttaccccggggggtaaccccctaaaggaaccgtaaggtacgttaccgaacgggtccggagtacggttcgaccgtacgaaacggctacgttcgtaactttccaacgtaactaaagaaactcgagagggtaaggtggagtgaaggaggttacgttgggtttaaagggtttctttaggagttcgagttacggacgtaacggctaacgtctaccggttggtcccttttacggccggtttaacgggcccgttaggggacgtaggacgttgaactttcgaccgtaaagtaaccgtactgggtcgtactcgtaaccctcg

SEQ ID NO: 304609 - DNA, 670 bp, Homo sapiens
  misc_feature: GZ8MTXP02FTRJP.25.15.B04.1.454.CMB.2.raw
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtgatgttgtgctgactcagtcctcccctctccctctccgtcaccttggacacgccgcctccactcctcctgacaagtctagtacaaacgtcctcgtctactattacgaacgaacacctactgctagttcggttccagtcgtgacggccgacggacctaatccgtaccgaacggaccgtaaccttaaagttaaagtttaacggtttaccggtaaccggggtaccggtaccgggggtaccaacggtacaagtacgttcgacggcggtacgacggtcgccggtacgacggactaccgtagttacttacaaccaacgtaagtaaaactcgaaggcggtaaggggtgggacggtgtaggaggttagtttgggtttaaggggtttatacgtagactagtagacgaacgacgaacaccgtacgttcgttaccgtttcggtcggttaccgggtacccggtagggaacggtaggacggttaggtaactcggtaccaaggtaccgagttcgggtgtcgttacggaccttaacg

SEQ ID NO: 304610 - DNA, 622 bp, Homo sapiens
  misc_feature: GZ8MTXP02FG6AU.25.15.B04.1.454.CMB.2.raw
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
tcagactgtacagtcacgaccggtgctcgatttagacagtatatatccgcgggggactgatcaggactcctcagttcaccttctcacaatgaggctccctgctcagctcctggggctgctaatgctctgggtcccaggatccagtggtnatgttgngctgactcagtcctcccctctccctctccgtcacccttggacacgccggccctcatcctcctgcaagtctagtccaaacgtcctcgtcacatacgaacggaaacacctactgctagttggtccagtctgacggcctacggaccaaactcctaccgaacggtccgaacccttaaatttaaacgtaacggtttaccgaaacccggggtacgtaccgggggtcccagacacggtacttcgagtccggcagtcgtccgtcgaagggtcctacgtgtaactttacaactaaccgtagtaaaactccgaagccgtagggtcgaagcgtaggacggtagtttgggttacgggtttatacgtgtacagtcgacgaacggtcactacgtacgtcggtaccttcggtcgttccgggacccgtgggtaccgagtagtacgtactacgtactaacgactacggcgtcgctacgacacg

SEQ ID NO: 304611 - DNA, 554 bp, Homo sapiens
  misc_feature: GZ8MTXP01CTG06.3.58.F03.1.454.CMB.2.raw
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (537)..(537): a, c, t, g, unknown or other
  misc_feature (537)..(537): n is a, c, g, or t
  modified_base (545)..(554): a, c, t, g, unknown or other
  misc_feature (545)..(554): n is a, c, g, or t
tcagagacgcactccacgaccggtgctcgatttagtctgatcgagaagggaaaggggttgtagtaggtgttcccacgggtatagacataaccaatccactccagtccccagggaagggactggagtggattggttatgtctatacccgtgggaacacctactacaacccctccctcaacagtcgggtcaccatatcagtggacccgtcgaagaaccaactctccctgaggttgacctctgtgaccgccgcagacacggtccctttattactgtgcgactgccctacgggaaccgggcgcgtaaggggtttgagggtctttgacatcgtggggccaaagggacgatggtcgccgtctcctcagcttccaccgaacgggccccagtccgtccttcccccgnggccgccccctgctcgaggacncccacctccgagacgccacncgtcccgcccgtgggcctgcccgttggtacgaacggaccttacttcccggagtcgccgttctcgtagggacggcgggggtctggggccaaggggcncgaagtgnnnnnnnnnn

SEQ ID NO: 304612 - DNA, 498 bp, Homo sapiens
  misc_feature: GZ8MTXP02IYXZW.3.58.F03.1.454.CMB.2.raw
  modified_base (403)..(403): a, c, t, g, unknown or other
  misc_feature (403)..(403): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (492)..(498): a, c, t, g, unknown or other
  misc_feature (492)..(498): n is a, c, g, or t
tcagagacgcactccacgaccggtgctcgatttagtctgatcgagaagggaaagggttgtagtaggtgttcccacgggtatagacataaccaatccactccagtccccagggaagggactggagtggattggttatgtctatacccgtgggaacacctactacaacccctccctcaacagtcgggtcaccatatcagtggacccgtcgaagaaccaactctccctgaggttgacctctgtgaccgccgcagacacggccctttatactgtgcgactgcctcggaaccgggcgcaagggttttgagggcttttgacatctggggccaagggacgatggtcgccgtctcctcagcttccaccaagggcccatcccgtcttccccctggcgccccctgctccaggngccactccgagagcacagcccgccctgggctgccctggtcaaggactacttccgagtgcgtcnctgagcgggctggcaagggcncangnnnnnnn

SEQ ID NO: 304613 - DNA, 526 bp, Homo sapiens
  misc_feature: GZ8MTXP01B70NA.9.75.G09.1.454.CMB.2.raw
  modified_base (226)..(226): a, c, t, g, unknown or other
  misc_feature (226)..(226): n is a, c, g, or t
  modified_base (412)..(412): a, c, t, g, unknown or other
  misc_feature (412)..(412): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttnttagttggtgctggtatcagcagaaaccgggaagccctaaatctgatctatgaggcctctggttacaaagtgggtcccatcaagattcagcgcagtgatcgtgggacaagaattcactctcacatcagcagtctgcagcctgatgtattttgctaaattatactgacaaactagtaataatattanccgtagactagttggaccgaaggggccgtaagggtaggaaagttacaaacggtaaacgtggttacgggcttacggaaccacctaagttctgttaccttcgttaacgtttccccg

SEQ ID NO: 304614 - DNA, 547 bp, Homo sapiens
  misc_feature: GZ8MTXP01AM3U8.9.75.G09.1.454.CMB.2.raw
  modified_base (190)..(190): a, c, t, g, unknown or other
  misc_feature (190)..(190): n is a, c, g, or t
  modified_base (377)..(377): a, c, t, g, unknown or other
  misc_feature (377)..(377): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggccagtcagaatgttctagtggttgctggtatcagcagaaaccggggaagcccctaaactcttgatctatgaggcctctggtttacaaagtggggtcccatcaagattcagcggcagtggatctggggacaagaaattcaactctcaccatcaagcagtctgcanctgatagtatttagtactaacttaattactacgaccgaaactaagtaaataaattaagttaagtacgtagtacgtagttacggtacgaaacgggaacggaagggtaaggaaagtaacgaaacgaaacgtagttaggcgttcgaacacctaactctcgttcttcttctccg

SEQ ID NO: 304615 - DNA, 523 bp, Homo sapiens
  misc_feature: GZ8MTXP01DHXN3.9.75.G09.1.454.CMB.2.raw
  modified_base (189)..(189): a, c, t, g, unknown or other
  misc_feature (189)..(189): n is a, c, g, or t
  modified_base (504)..(504): a, c, t, g, unknown or other
  misc_feature (504)..(504): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcttgccgggcagtcagaatgttcttagttggttgctggtatcagcaaggaaaccgggaaagcccctaaatcttgatctatgaggcctctggtttacaaaggtcgggtacccatacaagattcagcggcagtggatcgtagggacagtaaaattcaactctacaccatcagcagtctgcagctgatgtatttgactaacttatactgaccaatagtaataatagtatccgagactagttgaccgaagggaccgaggtaaggaaagttacaaaacgacgtggtggcttgccaactatcgttntcttctaacttccttcccg

SEQ ID NO: 304616 - DNA, 541 bp, Homo sapiens
  misc_feature: GZ8MTXP01CRIKH.9.75.G09.1.454.CMB.2.raw
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtcctccttccaccctgtctgcatctggtgggagacagagtcacatctctgccggcagtcagatgttctagttggtggctggtatcagcaaggaaaccgggaaacgcccctaaatctgatctatgagctgtggttacaagtgggtccatcaagatcagcgnagtggatcgtggaacagtaaattcaactctacaccatcagcagtcngcagctgatgtattttcgacttaacttatactagaccaaagtaagttaattaattagttactccgtaggtacttagttcggacgtaaggggaccgtagggtaaggaaagttacgtaaacgagtacggtggcttcgacctaacctattcgttcgtacttctaacgttcccttaaccccg

SEQ ID NO: 304617 - DNA, 524 bp, Homo sapiens
  misc_feature: GZ8MTXP01DYQP7.9.75.G09.1.454.CMB.2.raw
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctctgccgggcagtcagaatgttcttagtggtgctggtatcagcagaaaccgggaaancccctaaatcttgatctatgaggcctntggttacaaagtgggtccatcaagnttcagcggcagtggatcgtgggacagaaattcaactctcaccatcagcagtctgcagctgattgtattttgactaacttattacagacccaaatagttaataaataggttaatccgtaggtactagtttggacctaaagggaccgagggtaagaaagttcaaaacgttacgtgtggacttgacaacatctgtcttctaacttccgttaacccg

SEQ ID NO: 304618 - DNA, 631 bp, Homo sapiens
  misc_feature: GZ8MTXP01BBKIC.9.75.G09.1.454.CMB.2.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggccagtcagaatgttcttagtggtgctggtatcagcagaacggacgaccacatnantatgngctctggttataagagggtcgactcaagatctagcgcgagtggatctagggacgaagaaattctactcctctaccactacacgacgaacgtcgttgacgagtacccgtgtaagttagttaattttagttaccaaaccttttaaatttaccggggttacgaccgtaaacctaaagtttaattaaagttagtttaacgttaccggtttacgggtaaactaccgtttttagggtcccggaaaacggggttaaccgggacggggttaggggaaagttaaacccggaaaacggttaaaacgttggttaacggggcccttgtaacccggaaccctaagttccctttggttccgtttaacc

SEQ ID NO: 304619 - DNA, 534 bp, Homo sapiens
  misc_feature: GZ8MTXP01A0FIE.9.75.G09.1.454.CMB.2.raw
  modified_base (191)..(191): a, c, t, g, unknown or other
  misc_feature (191)..(191): n is a, c, g, or t
  modified_base (287)..(287): a, c, t, g, unknown or other
  misc_feature (287)..(287): n is a, c, g, or t
  modified_base (499)..(499): a, c, t, g, unknown or other
  misc_feature (499)..(499): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtcctccttccaccctgtctgcatctgtggganacagagtcaccatctctgccggcagtcagatgttcttagttggttgctggtatcagcagaaaccgggaagcccctaaatcttgatctatgagcctntggtttacaaagtcggggtccatcaagattcagcgcaggtggatcgtgggacaagaattcactctcaccatcagcagtctgcagcctgatgttatttgactaaccttattactcgactaaactagttaattaagttagttatccgtagtaactagtttcgggactaaggggaaccggaaggtaaggaagtacgaaacgtaacgtggttcggnttcgaacacctaatctcgttcttcgaacgttcccg

SEQ ID NO: 304620 - DNA, 533 bp, Homo sapiens
  misc_feature: GZ8MTXP01E2MU3.9.75.G09.1.454.CMB.2.raw
  modified_base (291)..(291): a, c, t, g, unknown or other
  misc_feature (291)..(291): n is a, c, g, or t
tcagtgatacgtctcacgaccggtgctcgatttagtatagacatcaggggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagaatgttcttagttggttgctggtatcagcagaaaccgggaagcccctaaactcttgatctatgaggcctntggtttacaaagtggggtccatcaagattcagcggcagtggatcgtgggacaagaattcactctcaccatcagcagtctgcagcctagattgtattttgactaaactttattactgaccaaactagtaataagtaagttatccgtagactagtttggacctaagggggaccgaagggtaggaaagtacgaaaacgtaaacgtgttcgggcttggccactaactctgttcttcaacgtttccc

SEQ ID NO: 304621 - DNA, 553 bp, Homo sapiens
  misc_feature: GZ8MTXP01A7NXZ.9.75.G09.1.454.CMB.2.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggagacagagtcacatctcttgccggcagtcagatgttcttagttggtgctggtatcagcagaaaccgggaancccctaatctgatntatgaggctcgtggttacaagtgggtccatacaagattcgagcggcagtggatcgagggacagaaattcaactctacaccatcagcagtctgcagcctgattgtattttgacttaacttattactagaccaaacgtaagttaacttaaattagtttactccggtagtaacgttagttacggtaccgtaacggggaccggtagggtaaggtaacgttacgaaacggacgtggtacggcgttcgacgtaaccattcgtcgttcttcgtaacttccgttaaccccg

SEQ ID NO: 304622 - DNA, 530 bp, Homo sapiens
  misc_feature: GZ8MTXP01BQQ1M.9.75.G09.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcttgccggccagtcagatgttcttagtggtgctggtatnagcagaaaccggggaaancccctaaatcttgatctatgaggcctgtggtttacaaaggtcgggtacccatacaagtattcgagtcggcaggtcggatcgtgggacagtaaaattcaactctacaccatcagcagtctgcagctgatgtattttgactaattatactgaccaatagttattaatagttatccgtagactagttcgaccgaagggaccgagggtaaggaaagttacaaacgaagtggtagccgttgccaactatctgtcttctaacttccgtaaccccg

SEQ ID NO: 304623 - DNA, 557 bp, Homo sapiens
  misc_feature: GZ8MTXP01AT1Y8.9.75.G09.1.454.CMB.2.raw
  modified_base (263)..(263): a, c, t, g, unknown or other
  misc_feature (263)..(263): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagaatgttcttagttggttgcctggtatcagcagaaaccgggaancccctaaatcttgatctatgaggcctctggtttacaaagtggggtcccatcaagattcagcggcagtggatcgtgggacaagaaattcactctacaccatcagcagtctgctagcctgatgtattttgactaacttattactgaccaaactagtaattaaatagttataccgtaggactagtttagggaccgtaaaggggtcccgaaggggttaggaaacggttacgaaaacggtaacttaagggttgggttcttaggccaacgtaactcttggttcctttcgaacgtttcccg

SEQ ID NO: 304624 - DNA, 561 bp, Homo sapiens
  misc_feature: GZ8MTXP01CYAXO.9.75.G09.1.454.CMB.2.raw
  modified_base (189)..(189): a, c, t, g, unknown or other
  misc_feature (189)..(189): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtcctccttccaccctgtctgcatctgtggganacagatcaccatctctgccggcagtcagatgttctagttggtgctggtatcagcagaaaccgggaagcccctaaatcttgatctatgaggcctcgtaggttacaaaggttcgggtacccatacgaagtattcgagcggcaggtggatcgtgggacagtaaattcaactctcacctatcagcagtctgcagctgatagtatttgactaacttattactagtacccaaataagtaataaattacgttaatccggtagtaactagtttcggaccgtaaaggggaccgaagggtaaggaaacgttacgaaaacggacgtaggtcggacgttcggaccaactatcgttacgtcttacctaacttcccgttaaccccg

SEQ ID NO: 304625 - DNA, 585 bp, Homo sapiens
  misc_feature: GZ8MTXP01DQZJ2.9.75.G09.1.454.CMB.2.raw
  modified_base (198)..(198): a, c, t, g, unknown or other
  misc_feature (198)..(198): n is a, c, g, or t
tcagtgatacgtctcacgaccggtgctcgatttagtatagacatcaggggggcaggagtcagacccagtcaggacacagcgtggacatgagggtccccgctcagctcctggggctcctgctgctctggctcccaggtgccaattgtgacatccagatcgacccagtctcccttccaccctgtctgcatctggtggganacagagtcacatctctgccggcagtcagatgttcttagttggtgctggtatcagcaagaaaccgggaacaccctaaactctagatctagtgacggtccttacgttaggtttaacgaaggttcgggggtacccatacaagtacttcgagccggcgagtggatcgtaagggacaagatcactctacacatcagcagtctgcagcctagtatgtatttacacttaactttacttacgtcgtaaccctaaataagttaattaaattagttacgtccggttagtacgttagttcggaacggtaaaggggtaccggaagggtagaaacgtaacgaaacggttaacgttgggttacggtctcgaacctacctattcgtaacgttccgttaaccg

SEQ ID NO: 304626 - DNA, 520 bp, Homo sapiens
  misc_feature: GZ8MTXP01D3XHF.9.75.G09.1.454.CMB.2.raw
  modified_base (189)..(189): a, c, t, g, unknown or other
  misc_feature (189)..(189): n is a, c, g, or t
  modified_base (254)..(254): a, c, t, g, unknown or other
  misc_feature (254)..(254): n is a, c, g, or t
  modified_base (496)..(496): a, c, t, g, unknown or other
  misc_feature (496)..(496): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttcaccctgtctgcatctgtggganacagagtcaccatctctgccggcagtcagatgttctagtggtgctgtatcagcagaaacgggaanccctaaatctgatctatgaggtcctgtggtttaacaaaggtcggggtaccccatacaagtattcagcggcaggtggatcgtagggacaagaattcactctacacatcagcagtctgcagtctgatgtatttgactaacttattactgacaaactagttaataattagttactccgtaggaactgttcggacgaagggccgaaggtggaagtacaaacgtacgtggttacgcttagcaacctnttctcgttacttcgttcgttcccg

SEQ ID NO: 304627 - DNA, 609 bp, Homo sapiens
  misc_feature: GZ8MTXP01AYFUV.9.75.G09.1.454.CMB.2.raw
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccacctgtctgcatctgtgggagacagagtcaccatctcttgccgggcagtcagtatgttcttagttggttgctggtatcagcaaggaaaccggggaaacgcccctaaactcttgatctatgagcctntggtttaacaaggtgggtccatcaagtattcagcggcaggtaggatcgtgggaacagaaacttcnctctacaccatcagtcagtctgtagcctgattgtattttgactaacttattactcgacctaacgtaaggttaattaaagttacgttacgttacccggtaggtaacttaaggttttacggggacccgtaaaggggggaccgtaagggggttaacggaaacgttaacgaaaacggtaaacgttggtacgggtcttaggaccaccctaagtttcctaagtttacccttacttaccttcccgtttccccgaacccg

SEQ ID NO: 304628 - DNA, 590 bp, Homo sapiens
  misc_feature: GZ8MTXP01C2Q7Q.9.75.G09.1.454.CMB.2.raw
  modified_base (190)..(190): a, c, t, g, unknown or other
  misc_feature (190)..(190): n is a, c, g, or t
  modified_base (263)..(263): a, c, t, g, unknown or other
  misc_feature (263)..(263): n is a, c, g, or t
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
  modified_base (561)..(561): a, c, t, g, unknown or other
  misc_feature (561)..(561): n is a, c, g, or t
  modified_base (573)..(573): a, c, t, g, unknown or other
  misc_feature (573)..(573): n is a, c, g, or t
  modified_base (590)..(590): a, c, t, g, unknown or other
  misc_feature (590)..(590): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtcctccttccaccctgtctgcatctggtggganacagatcacatctcttgccgggcagtcagtatgttctagttggtgctggtatcagacaaggaaacgggaaacnccctaaatcttagatctatgacgtccttagttaggttaacgaaacggttcgggtacccaataccgtaaagtcgtttacgacgaccggntaaggttggatacggtaggggaaactacgtaaaactttcaacgttcctacaacctanacaggacctaggtctagtacgtctagtattacgttattttacgaacttaacgtttattacacgtaaacctaaattaagggtaatttaagtacgttacgtaccgtaggtactagttacggacgtaagggacgaggtacgaagtacgaaagtacngtgtcagcactntctctctcttctcttcn

SEQ ID NO: 304629 - DNA, 697 bp, Homo sapiens
  misc_feature: GZ8MTXP01CYZKE.9.75.G09.1.454.CMB.2.raw
  modified_base (191)..(191): a, c, t, g, unknown or other
  misc_feature (191)..(191): n is a, c, g, or t
tcagtgatacgtctcacgaccggtgctcgatttagtatagacatcaggggggtcagacccagtcaggacacagcgtggacatgagggtccccgctcagctcctggggctcctgctgctctggctcccaggtgccaattgtgacatccagatgacccagtcctccttccaccctgtctgcatctggtggganacagagtcacatctcgtcggccggccagtcagatgttcttagttggtggctggtatcagacgaaggaaaccgggaacgacccctaaagtcttagatctatgacgtccttagttaggttaacaaacgggtcgggtaccccagtaccgtaaagacttacgaaggtcggacgtaggtcggagtcgtaggggaactaggtaaaaacttcctaaccgtctaccaacctactaccgagtactacggttctcggccaacggtcctagggtattaggttatttttacgaacttaacctttaagtacttacgaaccctaaaggtaacgtttaattaaagttagttacgtaccgggtagtaacgttacggtttacggaaacccggaaagggggtcccggtaaaggggtaacggtaaacgttaacgggaaaaccgttaccgtaggggttcgaccggttcgaaccgtaaccgttaacgtctttacgtacctttacctaaccgttcccctttaaccccg

SEQ ID NO: 304630 - DNA, 723 bp, Homo sapiens
  misc_feature: GZ8MTXP01EHCAV.9.75.G09.1.454.CMB.2.raw
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctctcggccggcagtcagtaattgttcttagttggttgctggtatcagacgaaggaaaccgggaacgacccctaaatctagactctagngacgcctgttaggttaacaaaggtcgggtacccatacaagtattcgagcgngacgtaggtagtacgtggtacgaaacgtaattaactactactacctaccactacgtacgacgtacgtacgttcgacggactaccgtcgttaagttagtttagtttacgttacgttaaactttaaacgtttacgttaaccgttaacgtaaaaccttaaaggttaaatttaaacgtttaaagtttaacgttacggttaccggtaacgttaacggtttaacgggttacccgggaaacggggtaacccggggtaaagggttaacggggttaaacgggtaaaccggttaaaaccgtaaacggttacggttaacggttcgggttaccgaacgtacccctaagttccttacggttcccgtttaaccgtttaaccgtttaacccccg

SEQ ID NO: 304631 - DNA, 620 bp, Homo sapiens
  misc_feature: GZ8MTXP01EBT0L.9.75.G09.1.454.CMB.2.raw
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagtgatacgtctcacgaccggtgctcgatttagtatagacatcaggggggagtcagacccagtcaggacacagcgtggacatgagggtccccgctcagctcctggggctcctgctgctctggctcccaggtgccaattgtgacatccagatcgacccagtcctccttccaccctgtcctgcatctggtgggananagagtccaccattctcgttgccggccagtcagtatgttcttaggttggtgctggtatcagcaacggaaaccgggaactacccctaaattctagattctagtgacggtccttgttacggtttaacaaaggtccggggttaccagttacgaaagtattacgaggcggcgtaggtggtaatcgtagggactaaagtacttcactcaccacctatcagactgtctgcacgtctntattgtatttcgacttaaacttatttacncgtaaccgtaataagttaaattaagttagttaacgtcggtagtaactggttaccgggacgaaacggggtccggaagggttacggaaagtaaaccgttaaacgacgttgggaccgttccaggtaacccaacttcgtcgttcgttactttccgttaactttccccg

SEQ ID NO: 304632 - DNA, 546 bp, Homo sapiens
  misc_feature: GZ8MTXP01BWL5F.9.75.G09.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
  modified_base (528)..(528): a, c, t, g, unknown or other
  misc_feature (528)..(528): n is a, c, g, or t
tcagtgatacgtctcacgaccggtgctcgatttagtatagacatcaggggggaaggagtcagacccagtcaggacacagcgtggacatgagggtccccgctcagctcctggggctcctgctgctctggctcccaggtgccaattgtgacatccagatgacccagtcctccttccaccctgtctgcatctggtggganacagagtcacatctctgccggcagtcagtatgttcttagttggtggctggtatcagcaaggaaaccgggaagccctaaatctgatntatgagcctntaggttaacaaaggtcgggtacccatcaagtnttcagcggcaggtgatcgngggaaacagtaatcactctccaacntacagctagtctgcacgcctagattgtacgtttnactaaactttattaaccgtggaactaaactagttaataaatagttacgtccgtagtactagtttcggaccgaaggggaacagggttaggaagttaacgaaacgattaggttggactgacaacctntcgttacttcttcgtaac

SEQ ID NO: 304633 - DNA, 544 bp, Homo sapiens
  misc_feature: GZ8MTXP01EM6YI.9.75.G09.1.454.CMB.2.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (514)..(514): a, c, t, g, unknown or other
  misc_feature (514)..(514): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctccaggtgccaattgtgacatccagatcgacccagtctccttccacctgtctgcatcgtgtgganacagatcacatctctgccggcagtacagtatgttcttagtgtgctgatcagcaggaaaccgggaanaccctaaatctagatctatgngtctagtgttaacgaaggtcgggtccatacgaatactgacgcgctagtgatcgaaggacaagattcgactcactaacatcanactgtcagcagtctagtntagtatttacacttaattagttacncgaactaaagaattaattaaacgtgttactacgtggtaactagttacgggacggtaaaggacggttaggtaaacgttaagtaaaccgtaaaggacgttggacgtaacgnaaccgtactattcctcggtttctttaaccc

SEQ ID NO: 304634 - DNA, 505 bp, Homo sapiens
  misc_feature: GZ8MTXP02IID52.9.75.G09.1.454.CMB.2.raw
  modified_base (347)..(347): a, c, t, g, unknown or other
  misc_feature (347)..(347): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggcagtcagaatgttcttagttggttgctggtatcagcagaaccgggaagcccctaaactctgatctatgaggcctctggtttacaagtggggtcccatcaaagattcagccggcagtggatcgtgggacngaattcactctcacatcagcagtctgcagcctgatgtatttgctaaacttattactgaccaacagtaataatagttatcgtgactagtttggacctaaagggaccgaggtacggaaagtacgaaaacgaaactgtaggctgacaccatctcgtcttac

SEQ ID NO: 304635 - DNA, 522 bp, Homo sapiens
  misc_feature: GZ8MTXP02H1YTT.9.75.G09.1.454.CMB.2.raw
  modified_base (188)..(188): a, c, t, g, unknown or other
  misc_feature (188)..(188): n is a, c, g, or t
  modified_base (281)..(281): a, c, t, g, unknown or other
  misc_feature (281)..(281): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggcagtcagatgttcttagtggtgctggtatcagcagaaacgggaagcccctaaatctgatctatgaggctntggttacaaagtgggtccatcaagtatcagcggcagtgatcgtgggacagaattcactctcacatcagcagtctgcagcctgatgtatttgactattatactgaccaacagttaataatagttatccgtagacttagtttcggaccgtaaaggggaccgtaagggtacggaaaacgtacgaaaacgtacgtagtcggtactagccaaacgtcttacgtcgttactctactcccgttccccg

SEQ ID NO: 304636 - DNA, 509 bp, Homo sapiens
  misc_feature: GZ8MTXP02H8KCE.9.75.G09.1.454.CMB.2.raw
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggcagtcagatgttctagttggtgctggtatcagcagaaaccgggaagcccctaaatcttgatctatgaggcctntggtttacaaagtggggtccatcaagnttcagcggcagtggatcgtgggacagaattcactctcaccatcagcagtctgcagcctgatgtattttgctaacttattactgaccaaactagtaataattagttactacgtgactagtttggaccgaagggaccgaggtaggaagtacgaaaacgactgtacggctcgcacgactctagtcttacactttcccg

SEQ ID NO: 304637 - DNA, 533 bp, Homo sapiens
  misc_feature: GZ8MTXP02JX8YL.9.75.G09.1.454.CMB.2.raw
  modified_base (188)..(188): a, c, t, g, unknown or other
  misc_feature (188)..(188): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggcagtcagatgttcttagttggtgctggtatcagcagaaaccggggaagcccctaaatctgatctatgaggcctctggttacaaaggtgggtcccatcaagnttcagcggnagtggatcgtggggacagaattcactctacaccatcagcagtctgcagcctgatgtattttgactaaactttattactagaccctaaatagttaataaattagtttaactcccgtaggtactagtttcggaccgtaaggggaccgagggttacggaagtacgaaacgaacgtggtacgctgaccaacctagtctgtcttcactccttccccg

SEQ ID NO: 304638 - DNA, 519 bp, Homo sapiens
  misc_feature: GZ8MTXP02J04P9.9.75.G09.1.454.CMB.2.raw
  modified_base (194)..(194): a, c, t, g, unknown or other
  misc_feature (194)..(194): n is a, c, g, or t
  modified_base (262)..(262): a, c, t, g, unknown or other
  misc_feature (262)..(262): n is a, c, g, or t
  modified_base (342)..(342): a, c, t, g, unknown or other
  misc_feature (342)..(342): n is a, c, g, or t
  modified_base (410)..(410): a, c, t, g, unknown or other
  misc_feature (410)..(410): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggccagtcagatgttctagtggtgctggtatcagcagaaccgggaancccctaaactctgatctatgaggcctctggtttacaaaggtgggtcccatcaagattcagccggcagtgatcgtgggacngaattcactctcaccatcagcagtctgcagcctgatgtattttgactaaatttattactgaccctaanagttaataatagttatccgtggacctagtttggacctaagggggaccgagggtacggaaagtacgaaaacgtaacgtggtcggcgtcgacacctatctcgtctttaccg

SEQ ID NO: 304639 - DNA, 524 bp, Homo sapiens
  misc_feature: GZ8MTXP02HN5HK.9.75.G09.1.454.CMB.2.raw
  modified_base (194)..(194): a, c, t, g, unknown or other
  misc_feature (194)..(194): n is a, c, g, or t
  modified_base (260)..(260): a, c, t, g, unknown or other
  misc_feature (260)..(260): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggcagtcagatgtcttagtggtgctgatcagcagaaaccgggaancccctaaatctgatctatgaggcctctaggtttaacaaaggtggggtcccatcaagtattcagccgcagtgatcgtgggacagtaattcactctcaccatcagcagtctagcagcctgatgtattttgactaaactttattactcgtacctaaactagtaattaaattagttactccggtagactagtttcggaccgtaaggggaccgaggtacggaaagttacaaaacgaacgtggtggaactgactaccatcctgttcttac

SEQ ID NO: 304640 - DNA, 601 bp, Homo sapiens
  misc_feature: GZ8MTXP02F8WDC.9.75.G09.1.454.CMB.2.raw
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggctggtatcagcagaaaccggggaaagcccctaaatcttgatctatgaggcctctggtttacaaagtggggtcccatcaagattcagcggcagtggatctggggacagaattcactctcaccatccagcagtctgcagcctgatgattttgactaacttattactgacctaaactagtaattaattaagtttatcccgttaggactagtttacgggaccgtaaagggggaccgtaagggttagggaaaaggttaccgaaaaacgggtaaaccgtagggttacgggtaccgttagggacctaacccgtaaacgtttacctcggtttaacccttttccgtaacgtttaccccgttttaccccccg

SEQ ID NO: 304641 - DNA, 501 bp, Homo sapiens
  misc_feature: GZ8MTXP02FZH8V.9.75.G09.1.454.CMB.2.raw
  modified_base (190)..(190): a, c, t, g, unknown or other
  misc_feature (190)..(190): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggccagtcagatgtcttagttggtgctggtatcagcagaaaccgggaagcccctaaactcttgatctatgagcctctggtttacaaaggtggggtcccatcaagattcagcggcagtgatcgtgggacagaattcactctcaccatcagcagtctgcagcctgatgtattttgctaacttattactgaccaactagtacttaatagttactcgtaggactagttggaccgaagggaccgaggtggaaagtacaaagactgtcggctgcaccgatctagttctcattccc

SEQ ID NO: 304642 - DNA, 534 bp, Homo sapiens
  misc_feature: GZ8MTXP02FOVWD.9.75.G09.1.454.CMB.2.raw
  modified_base (312)..(312): a, c, t, g, unknown or other
  misc_feature (312)..(312): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggcagtcagatgttctagttggtgctggtatcagcagaaaccggggaagcccctaaactcttgatctatgaggctctggtttacaaagtgggtccatcaagnttcagcgcagtgatcgtgggacagaattcactctcaccatcagcagtctgtagcctgatgtatttgctaactttatactgaccaaactagtaataatagttatccgtaggactagtttacgggaccaaaggggaccgtagggtacggaaaacgtacgaaaacggtacgtggtacggcgtacgacacctaagttcctagtctttaccacttccgttcccgtac

SEQ ID NO: 304643 - DNA, 529 bp, Homo sapiens
  misc_feature: GZ8MTXP02JULFY.9.75.G09.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
  modified_base (528)..(528): a, c, t, g, unknown or other
  misc_feature (528)..(528): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttgcctggtatcagcagaaaccggggaaagcccctaaacncttgatctatgagcctntggtttacaaagtggggtcccatcaaagnttcagcggcagtggatcgtgggacagattcactctcaccatnagcagtctgtagcctgatgattttgctaaactttntacttgaccaaatagtataatagttatccggtagactagtttggacgaaaggggtaccgaggggttacggaaacgtacgaaacgaactaggtcgggctcgaccacaacttctgtcttcacttcctacccnc

SEQ ID NO: 304644 - DNA, 490 bp, Homo sapiens
  misc_feature: GZ8MTXP02F83FW.9.75.G09.1.454.CMB.2.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagatgttctagtgtgctggtatcagcagaaaccgggaaagcccctaaatctgatctatgaggcctctggtttacaaagtggggtcccatcaagattcagcggcagtggatctgggacagaattcactctcaccatcagcagtcngcagctgatgtatttnactaattattactcacaanataataatagttactcgtagactagttcgacgaaggacgaggtaggaagtacgaaacgacgtgtacgctagaacacactctgtctctactc

SEQ ID NO: 304645 - DNA, 533 bp, Homo sapiens
  misc_feature: GZ8MTXP02H36UR.9.75.G09.1.454.CMB.2.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctctgccggcagtcagatgtcttagttgtgctggtancagcagaacggaanccctaaatctgatctatgagcctctaggttacaaaggtgggtccatcaaagatcagcgcagtggatcgtgggacagaattcnctctcaccatcagcagtcngacacgctagattgttatttagacttaaactttacttacagaccaaatagttaataattagttatcgtagtactagtacggacgaaggggacgtaggtacggaacgtaacaaaacgtacgtggtacggtctacgacctaacgtactacgttcgttacctttactacgtttacccgtcccg

SEQ ID NO: 304646 - DNA, 554 bp, Homo sapiens
  misc_feature: GZ8MTXP02GRDU4.9.75.G09.1.454.CMB.2.raw
  modified_base (191)..(191): a, c, t, g, unknown or other
  misc_feature (191)..(191): n is a, c, g, or t
  modified_base (245)..(245): a, c, t, g, unknown or other
  misc_feature (245)..(245): n is a, c, g, or t
  modified_base (356)..(356): a, c, t, g, unknown or other
  misc_feature (356)..(356): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcttgccgggcagtcagatgttcttagtggtgctggtatnagcagaaacgggaagaccctaaactctgatctatgaggcctctggtttacaaagtggggtcccatcaagatcagcgcagtgatcgtagggacagatcactctcaccatcancagtctgcagctgatgtatttgactaacttattactgacctaatagttaataaattagttaactccgtaggtactagtttggaccgtaaaggggaccgtaagggtacggaaagttacgaaaacggtaaccgtaggtacggtacttaggaaccgaacccgtaattccgttacggttacctttactaaccgttttccccg

SEQ ID NO: 304647 - DNA, 529 bp, Homo sapiens
  misc_feature: GZ8MTXP02GNJMT.9.75.G09.1.454.CMB.2.raw
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggcagtcagatgttcttagttggtgctggtatcagcagaaaccgggaancccctaaatcttgatctatgaggcctctggtttacaaagtgggtcccatcaagnttcagcggcagtggatcgtgggacagaattcnctctcaccatcagcagtctgcagcctgattgtattttgactaacttatactgaccaaatagttaataagttagttataccggtagtactagtttacggaccgaaggggtaccgagggtacggaacggtacgaaaacgaactggtcgactgaccaactatcgttctcttacacttccgtaccccg

SEQ ID NO: 304648 - DNA, 563 bp, Homo sapiens
  misc_feature: GZ8MTXP02IEQXK.9.75.G09.1.454.CMB.2.raw
  modified_base (191)..(191): a, c, t, g, unknown or other
  misc_feature (191)..(191): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcttgccgggcagtcagaatgttcttagttggttggctggtatcagcaagaaaccggggaancccctaaatcttgatctatgaggcctntggtttaacaaaggtggggtcccatcaagattcgagcggnagtggatcgtgggacagattcactcncaccatcagcagtcngcncgctgatgttatttacgacttaacttattactcgacctaataagttaattaagttagttacgtacgtaggtaacttagtttacggaccggtaaaggggaccggtagggtaggaaacgtaacgaaaacggacgttcggtacggtactacgaacctacgtattcgtcgtttaccttactacttcccg

SEQ ID NO: 304649 - DNA, 554 bp, Homo sapiens
  misc_feature: GZ8MTXP02HRXPE.9.75.G09.1.454.CMB.2.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtnccaattgtgacatccagatgacccagtctccttccaccctgtctgcatctgtggganacagagtcaccatctcttgccggcagtcagatgttcttagttgtgctgtntnagcagaaccgggaanacccctaaatctgatctatgagcctntggttacaaaggtgggtccatcaagtatcgagccggnagtgatcgtgggacngtaattcactctcacatcagcagttcngcngctgattgtatttacgacttaaatttacttactactaacctaattaagttaattaagttagttacgttcgtagtacttagttacggaaccggtaacgggtacggtaggtaacggtaaacgtaacgaaaacgtacgttaggtacggtaacgtacgactacgtacgtttcgttacgtttaccttacg

SEQ ID NO: 304650 - DNA, 519 bp, Homo sapiens
  misc_feature: GZ8MTXP02IJDFM.9.75.G09.1.454.CMB.2.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (408)..(408): a, c, t, g, unknown or other
  misc_feature (408)..(408): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcttgccggcagtcagatgtnttagtggtgctggtatcagcaggaaaccggggaaancccctaaatcttagatctatgagcctntggttacaaaggtgggtcccatcaaagattcagcggcaggtgatcgtagggacagaattcactctacaccatcagcagtctgcagcctgattgtatttgactaacttattactgaccaaanagttaataaattagttataccgtgactagtttggaccaaagggaccgaggtaggaagtacaaaacgtactaggtcgactgactaacatctcgtactcctaccttcccgacc

SEQ ID NO: 304651 - DNA, 545 bp, Homo sapiens
  misc_feature: GZ8MTXP02G1FRC.9.75.G09.1.454.CMB.2.raw
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcttgccggcagtcagatgttcttagttggtgctggtatcagcagaaaccgggaagcccctaaatctgatctatgaggcctntggtttacaaaggtcggggtccatcaagtattcagcggcagtggatcgtgggacagaattcactctcaccatcagcagtctgcagcctgatgtattttgactaacttnttactgaaccaactagtattaattagtttacgtccggtaggtactagtttcggaccgtaaaggggaccggtaagggtaggaaacgtacgaaaacggtaacgtggtacggactagaacctaccaagttctagtcctttactactttccccg

SEQ ID NO: 304652 - DNA, 685 bp, Homo sapiens
  misc_feature: GZ8MTXP02FI2S4.9.75.G09.1.454.CMB.2.raw
  modified_base (188)..(188): a, c, t, g, unknown or other
  misc_feature (188)..(188): n is a, c, g, or t
  modified_base (239)..(240): a, c, t, g, unknown or other
  misc_feature (239)..(240): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (666)..(666): a, c, t, g, unknown or other
  misc_feature (666)..(666): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtgganacagagtcaccatctcttgccggcagtcagatgttctagttggtgctgtannagcaaggaaaccgggaancccctaaatctagactntagtgacgtcctcgttaggtttaacaaaggtcgggtacccagtaccgaaagtacgttacgacggcggacgtaggtcggtaattccggaggggaaccaaggtaacttcctacctcctaccaacctatacgaacgtcaacgttcctaggaccctacgtcctagtaagttagtagtttttacgaaccttaaactttaacttaccgtacgaaaccctaaaagttagttaaattaaacgtttacgttaacgtcccggttagtaaccttagggtttacggaacccggaaaaggggtacccgggtaaggtaaacgggtaaacgtaaccggtaaaaacgtccggttaggtaccgggtactacggaccctaacgtactttccgttacgttcctttaaccnccttccccgtttaaccccg

SEQ ID NO: 304653 - DNA, 524 bp, Homo sapiens
  misc_feature: GZ8MTXP02IK037.9.75.G09.1.454.CMB.2.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttcttagtggtgctgtatcagcagaaaccgggaagccctaaatctgatctatgagccttctggtttaacaagtggggtccatacaagattcagcgcagtcgatntgggacagattcactcncacatcagcagtctgcagctgatgtattttgactaattatactacgacccaaatagtaattaattagttaactaccggttagactagtttacggaccgtaaagggaccggtagggtacggaaagttacaaacggtactaggtcggctgacaactattcgtacgtcttactactctttacccg

SEQ ID NO: 304654 - DNA, 580 bp, Homo sapiens
  misc_feature: GZ8MTXP02FWC58.9.75.G09.1.454.CMB.2.raw
  modified_base (287)..(287): a, c, t, g, unknown or other
  misc_feature (287)..(287): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttctagttggttgctggtatcagcagaaaccggggaaagcccctaaactcttgatctatgagcctntggtttacaaagtggggtcccatcaagattcagcggcagtggatcgtgggacagattcactctcaccatcagcagtctgcagcctgatgattttgactaacttattactagacccaaatagtaattaaacttagtttaactcccggtaggtactacgttttacggaccgtaaaaggggaccggtaagggtacggaaaacggttacgaaaaacggtaaccgtaggttacgggacccttaggaccaaccgtaacttaccgttacggttcctttactaacttccctttacccccgg

SEQ ID NO: 304655 - DNA, 629 bp, Homo sapiens
  misc_feature: GZ8MTXP02IPWIN.9.75.G09.1.454.CMB.2.raw
  modified_base (191)..(191): a, c, t, g, unknown or other
  misc_feature (191)..(191): n is a, c, g, or t
  modified_base (340)..(340): a, c, t, g, unknown or other
  misc_feature (340)..(340): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcacctatctcttggccgggccagtcagaatgttcttagttggtgctggtatcagcgaagaaaccggggaacacccctaaatcttagatctagtgacggtcctcgttaggtttaacaaaggtcgggtacccagtacgaaagtnttacgaggcggctaggtggagtttgggactagtaacttcacttctaccaccataccagctagtctgacagctgtattagtattttcgacttaacttacttactacgacctaaacgtattaaatttaaagttacgtttacgtcggttacggtaacttaacggtttacgggaaccgtaacggggtaacgagggttaacggaaacgttaaaccgtaaacgtaaacgtggtacgtacgtaccgactaaccgttacttaccgttacgttaccttacctaccgttcccgtacccg

SEQ ID NO: 304656 - DNA, 506 bp, Homo sapiens
  misc_feature: GZ8MTXP02IW2PY.9.75.G09.1.454.CMB.2.raw
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggcagtcagatgttcttagttggtgtctggtatcagcagaaaccgggaanccctaaatctgatctatgagctntgttacaagtggccatcagntcagcgcagtcgatcgtggacagattcnctctcaccatcagcagtctgcacgctgatgtatttgactaacttatactgacctaaatagtataattagttataccgtgaactagtttcggacctaaggggaccgtaaggtacggaaagtaccgaaaacgtacgtgtacggactcgacaacctagtctacgtcttcactctacccg

SEQ ID NO: 304657 - DNA, 514 bp, Homo sapiens
  misc_feature: GZ8MTXP02I93KL.9.75.G09.1.454.CMB.2.raw
  modified_base (188)..(188): a, c, t, g, unknown or other
  misc_feature (188)..(188): n is a, c, g, or t
  modified_base (280)..(280): a, c, t, g, unknown or other
  misc_feature (280)..(280): n is a, c, g, or t
  modified_base (513)..(513): a, c, t, g, unknown or other
  misc_feature (513)..(513): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggccagtcagatgttcttagttggtgctggtatcagcagaaaccgggaaagcccctaaatcttgatctangagcctctggttacaaaggtgggtcccatcaagattcagcggcagtggatcgtgggacaggaattcactctcaccatcagcagtctgtagcctagattgtattttgactaactttatactgaccaatagtataatagttataccgtgtactagtttggacaaggggaccgagggtaggaacgtacgaaacgacgtagtggactgacaccaattctgtacttcactccttcccnc

SEQ ID NO: 304658 - DNA, 667 bp, Homo sapiens
  misc_feature: GZ8MTXP02IXIYH.9.75.G09.1.454.CMB.2.raw
  modified_base (194)..(194): a, c, t, g, unknown or other
  misc_feature (194)..(194): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcgttgccggcagtcagtatgttcttagttggtgctggtatcagcgaaggaaaccgggaacgacccctaaactcttagatctagtagacgtccttacgttaggtttaacgaaacggttcggggtacccaagttactaaaggtacttacggacggcccggacgtaggtggtactcggtaggggaacaggtaaacttcaccttcacctaaccataccagcctaggttcctggacacggtacctgtaattgtaacttttagacctttaaactttactttaccgtacgtaacccaaagtaagttaattaaacgttacgtttaacgtaccggttaaggtaccttaaggtttacgggaacccggtaaaacgggggtaccggtaaggggtaacggtaaacgtaaaccgaaacgtaaccgtggtacggtaacgtacgacctacgtacttcgttcgttaacctttccg

SEQ ID NO: 304659 - DNA, 598 bp, Homo sapiens
  misc_feature: GZ8MTXP02G40GE.9.75.G09.1.454.CMB.2.raw
  modified_base (194)..(194): a, c, t, g, unknown or other
  misc_feature (194)..(194): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcacatctcttgccggcagtcagaatgttcttaggttggttggccttggtatcagcgaaggaaaccggggaaacgacccctaaactcttagatctatgacggcctctggtttacaaaggtcggggtcccagtacaagtattcagccggacagtggatcgtagggacagtaattcacttcncacatcagcagtctagcagcctgatgtatttgactacttagttctagaccaaanagttataagttagttattccggtaggtaacctagtttcgggaccgtaaaacgggggtaccggtaaagggttacgggaaaagttaccgaaaaacgggtaccgttaggggttacggaacttacgggtaccaaacccggttactttaccgttacgtttacctttacg

SEQ ID NO: 304660 - DNA, 570 bp, Homo sapiens
  misc_feature: GZ8MTXP02GKL2Z.9.75.G09.1.454.CMB.2.raw
  modified_base (189)..(189): a, c, t, g, unknown or other
  misc_feature (189)..(189): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (554)..(554): a, c, t, g, unknown or other
  misc_feature (554)..(554): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgcatctgtggganacagagtcaccatctcttgccggcagtcagatgttnttagtggtgctgtatcagcaaggaaaccgggaanacccctaaactctgatctatgaggcctctaggtttaacaaaggtcgggtacccatcaagtattcagcggcaggtggatcgtaggggacagtaattcactctacaccatcaagcagtctgcagctgatgtatttagactaaacttattaactcgtaacccaaataagttaataaaagttagttaaacgtccgttagggaacttagtttacggacccgtaaaagggggaccgtaaggggtaggtaaaacgtaacgaaaacggtaaaccgtggtacggctacgaactaacacgttctntacttactacttcccg

SEQ ID NO: 304661 - DNA, 630 bp, Homo sapiens
  misc_feature: GZ8MTXP02IYZZ6.9.75.G09.1.454.CMB.2.raw
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (429)..(429): a, c, t, g, unknown or other
  misc_feature (429)..(429): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttaggttggttggctggtatcagcaaggaaaccggggaaacacccctaaatcttgatctatgaggtcctcgtggtttaacaaaggtcggggtccccaatcaagattcaggcggcaggtggatcgtagggacagtaacttcactctaccaccatcagnaacgtcngcagcctgtatgatttcgacttaaacttatttaacngacctaaaatagttaaattaaagttaagtttaactccggttaacggtacttaacgtttacgggaacccggaaaagggggtacccggtaaggggtacggtaaaacggttaaccgaaaaacgggtaacgttagggttacgggaccttacggaacccaaccgttaacgttccgttacggtttcctttaaccgtactttcccccg

SEQ ID NO: 304662 - DNA, 755 bp, Homo sapiens
  misc_feature: GZ8MTXP02H9YFR.9.75.G09.1.454.CMB.2.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcttgccggcagtcagatgttcttagttggttgcctggtatcagcaagaaaccgggaacaccctaaatctagatctatgacggtcctgttaggtttaacgaaggttcggggtcccctaataccaaaggtactttacgaggccggagacggtagggtaacttcggttacgggggaaacctaagggtaaaacttttccaaaccctttcttaccccaaacccctaattacccgaaacggccctaaacgggtttcccgtacggaccgtacggtaccgttaggtagtttacgtttacttttaccgaacctttaaactttaacgtttacctacggtaaacctaaaagttaagttaaatttaaacgtttaacggtttaaccgttaccggtacggttaacgttaacggtttacggggaaccgggtaaaacgggggtaaccgggtaacggggtaaacgggtaaaacggttaaacggtaaaaccggtacgttacggtaccggtacgtacgaaccctaaccgtacgttccgttacgtttacctttaccgttaaccgtcccg

SEQ ID NO: 304663 - DNA, 536 bp, Homo sapiens
  misc_feature: GZ8MTXP02JOZLR.9.75.G09.1.454.CMB.2.raw
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (519)..(519): a, c, t, g, unknown or other
  misc_feature (519)..(519): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggcagtcagaatgttcttagttggttgctggtatcagcaaggaaaccgggaancccctaaatcttagatctatgagtcctntaggttaacaaaggtgggtacccatacaagattcgagcggnagtgatcgtaggacagaactcactctacaccatcagcagtctgcagcctgatgtattttcgactaacttattacngtaccaaatagtaattaatagttacgtcgtagtactagttcggacgaagggacgagggtagaacgtaacaaaacggtactaggtcgacgtagaactaaccgtattacgtnttccttacactttcccg

SEQ ID NO: 304664 - DNA, 612 bp, Homo sapiens
  misc_feature: GZ8MTXP02HWTSQ.9.75.G09.1.454.CMB.2.raw
  modified_base (189)..(189): a, c, t, g, unknown or other
  misc_feature (189)..(189): n is a, c, g, or t
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcgtgccggcagtcagattgttcttagttggtgctggtancagcgaaggaaaccgggaacacccctaaatctagatctagtgacgtccttgtaggtttaacgaaggtcgggtaccagtacaagtntcgagcgcaggtcgatcgtagggacaagtacttcnctcacacgatacagctagtctgacacgtccttagatttaggttacttttagaccttaaactttataaccgtacgaaccctaaagtaatttaaagtaaacttaggttacgtccgtaaggtaacttacggttacggaaccgtaaggggtacgaaggggttaacggaaaaggttaacgaaaaccggtagtcgggtacgacgtacgactaaccgttgttaccgttacgttacttccgtacgtttcccgtaccg

SEQ ID NO: 304665 - DNA, 473 bp, Homo sapiens
  misc_feature: GZ8MTXP02HUCMI.9.75.G09.1.454.CMB.2.raw
  modified_base (464)..(473): a, c, t, g, unknown or other
  misc_feature (464)..(473): n is a, c, g, or t
tcagtgatacgtctcacgaccggtgctcgatttagtatagacatcagggtgctgctgaggctgtaggtgctgtccttgctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgatttttgctaactttatactgaccaacagtataatagttatccgtggtacatttggcctaaaggggaccgagggttaggaaagtcaaacgaactgtggctgcacatcctgtctctactcttaccccgcatctgaagacgtatcactgaggcgggctggccaaggcgcatagnnnnnnnnnn

SEQ ID NO: 304666 - DNA, 535 bp, Homo sapiens
  misc_feature: GZ8MTXP02JVULO.9.75.G09.1.454.CMB.2.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctctgccggcagtcagatgttcttagttggtgctggtatcagcagaaacgggaacncccctaaatctgatctangacgtctcgtaggttacaaaggtcgggtacccatacaagtnttacgagcggcaggtgatcgtagggacagaattcactctacacatcancagtctagcagctgatgtatttcgactacttattacagtaccaactagtaatacgttagttactaccgtagtactagtttacggacgtaagggacgtaggtacggaagtacgaaacgtacgtcggtacgactgaacctactacgttctacgtacttacactttccccg

SEQ ID NO: 304667 - DNA, 544 bp, Homo sapiens
  misc_feature: GZ8MTXP02GCE7X.9.75.G09.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcttgccggcagtcagatgttcttagttggtgctggtatcagcagaaaccgggaancccctaaatcttgatctatgagctntggttacaagtgggtccatcaagattcagcgcagtgatcgtgggacagattcactctacaccatcagctagtctgtacgcctagattagtatttgacttaacttattactagaccaaactagttaagtaaattacgttatccggtagactagtttacgggaacgaaggggtaaccgagggtaaggaaacgtacgaaaagtacgtggtcggactacggacctaacgaattccttagttacttacgactttcctcccgtaac

SEQ ID NO: 304668 - DNA, 609 bp, Homo sapiens
  misc_feature: GZ8MTXP02FUOIX.9.75.G09.1.454.CMB.2.raw
  modified_base (191)..(191): a, c, t, g, unknown or other
  misc_feature (191)..(191): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctcttgccggccagtcagatgttcttaggttggtgctggtatcagcaagaaaccgggaacgcccctaaatcttagatctatgaggccttctaggtttaacaaaaggttcggggtaccccagtaccaagtacttcgaggcggcacggtggactcgtagggacagaattcactctcaccatcagctagtctgcagcctgatgttatttcgacttaaacttattacacgacctaacgtattaattaattaacgtttacgtaccggttaggtaacttacggtttcggaaccgtaacgggggaccggtaaggggtacgggaaagttaaccggaaaacgtaacgtcggtaacgggtccttacggaacctaaccgtaacttcggttacgttccttacctctttaacccccgg

SEQ ID NO: 304669 - DNA, 567 bp, Homo sapiens
  misc_feature: GZ8MTXP02GUNIJ.9.75.G09.1.454.CMB.2.raw
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctctggccgggcagtcagaatgttnttagttggtgcctggtatcagcaaggaaaccggggaanacccctaaatcttagatcangngcctntggtttaacaaaggtcggggtacccagtcaagtattcgagcggtacaggtggatcgtagggacagaacttcactctacacatcagcagtctgcagctgagttcgtattttagacttaaacttattaacgtcgtaacctaaactagttaaataagttaagttacgtaccgtagtacgttaagtttcgggacgtaagggaaccggtagggtacggaaagtacgaaaacgacgtagtcggacgtcgaacgactacgtctgtactcgacctttcccg

SEQ ID NO: 304670 - DNA, 652 bp, Homo sapiens
  misc_feature: GZ8MTXP02JAJ81.9.75.G09.1.454.CMB.2.raw
  modified_base (192)..(192): a, c, t, g, unknown or other
  misc_feature (192)..(192): n is a, c, g, or t
  modified_base (633)..(633): a, c, t, g, unknown or other
  misc_feature (633)..(633): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatcgacccagtctccttccaccctgtctgcatctggtggganacagagtcaccatctcttcggccgggcagtcagtattgttcttaggttggttcggctggtatcagcaaggaaaccggggaacacccctaaatctagactctagtgacggtcctcgttaggtttaacgaaacgggtcggggtacccagtacgaagtacttcgaggcggctagggtaggactcggtacggggactaagtaactttccactcctcaaccctatcaggctacgtctggcacgtcctagattggttaattttcgaaacttaacgtttattaacccgttacgaaccctaaaacgtagttaaaattaaacgtttaacgttaaccggtccggttaaggtaaccgtttaggttacggaaccgggtaaacggggtaccgtaacggggtaggaaacgtacgaaaacggtacgtggtacggcttacaaccgtacctagttctnttccttacgtactttcccg

SEQ ID NO: 304671 - DNA, 659 bp, Homo sapiens
  misc_feature: GZ8MTXP02F5Q1Z.9.75.G09.1.454.CMB.2.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtggganacagagtcaccatctctgccgggcagtcagatgttcttagttggtgctgtntnagnaagaaacgggaacnccctaaatctgatctagtgacggtcctcgttaggtttaacgaaaaggttcggggtaccccaagtaccgtaaaggtactttcgaaggccggacgtaaggttggacttcggtacggggaacaaggtaacttccactctacaccatacgaaggcctaagtctaggacaggtcctagacttggttaattttacgacttaaacttattacctagtaacctaaagtattaaattaaacgttagttacgtaccggttaggtaacttacggtttacgggaaccggtaaacgggggtaaccggtaaggggttaacgggaaaaggtaaccgtaaaaaccgggtaacgttcggttacgggacttacggaaccgtaacctagttcgtacgttccttactaactttccccg

SEQ ID NO: 304672 - DNA, 620 bp, Homo sapiens
  misc_feature: GZ8MTXP02H3ODT.9.75.G09.1.454.CMB.2.raw
  modified_base (188)..(188): a, c, t, g, unknown or other
  misc_feature (188)..(188): n is a, c, g, or t
  modified_base (221)..(221): a, c, t, g, unknown or other
  misc_feature (221)..(221): n is a, c, g, or t
  modified_base (233)..(236): a, c, t, g, unknown or other
  misc_feature (233)..(236): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (278)..(279): a, c, t, g, unknown or other
  misc_feature (278)..(279): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagtgatacgtctcacgaccggtgctcgatttagtatagacatcagggggtcagacccagtcaggacacagcgtggacatgagggtccccgctcagctcctggggctcctgctgctctggctccaggtgccaattgtgacatccagatgacccagtctccttccaccctgtctgcatctggtggganacagagtcacatctctgccggcagtcagatgtnttagtgtgctgnnnnagaacgancatntgntnangngtctntagtacaagtcggcannantgagcgnagtgatgtggactagtactcnctctacaccatacagtcacgtcgtacgcgtacgcccgtagtcgtttacgtttacgactttaaactacgttactaacgacccttaaagtaacgtttaaattaaagttacggttaactaccggttaaggtaacctttagggtttaaccggaaccggtaaaaggggtaccggtaaggggtaaacggtaaacggtaaaacccgtaaacggtacgttcggggtacgtaaccggtcgtaacccgaaccgttaacgtttaccgttaaccggtttccttacccgtttaacccgtttcccccggtttaaccccgtaaccg

SEQ ID NO: 304673 - DNA, 823 bp, Homo sapiens
  misc_feature: GZ8MTXP02HW5K9.9.75.G09.1.454.CMB.2.raw
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatcgtggtgggagacagagtccaccatcctcgttggccggccagtcagtattgttcttagttggtggcctggtatcgagcgaacggaaaaccggggaacaccccctaaatcgttagattactatggacggtaccgtttcttaggtttaacgaaaggtcggggtaccccatttacgaaagtacttcgaggtcgggactaggtccgggattcggtacggggaactacggtaaactttaccgaccttaccgttaccaaacccgtaacttaccgaacgtacgttacggttaccgttaggtaacggtcccgttaaggttacgttaggttttaacttttttaaccggacctttaaaacgttttaaacctttaccgttaaccggtaaacccccgtaaaattaaaggtttaaaaccttttaaaagtttaacggttttaaacgttaccccggtttaagggtaaccgttaacggtttttaccggggaaccgggttaaaacgggggaacccgggttaagggggttaaacgggtaaaacggtttaacccggaaaaccggttaaaccgttggggtaacggtccgttacgaccgtaaccgtaactttaccggtttacgtttccctttaccgtaaccctttcccgttttaccccggtaccc

SEQ ID NO: 304674 - DNA, 594 bp, Homo sapiens
  misc_feature: GZ8MTXP02F5P3E.9.75.G09.1.454.CMB.2.raw
  modified_base (190)..(190): a, c, t, g, unknown or other
  misc_feature (190)..(190): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggcagtcagatgttcttaggttggttggcctggtatcagcaagaaaccggggaaagcccctaaactcttgatctatgagcctctaggtttacaaaggtggggtacccatacaagtattcgagcggcagtggatcgtagggacagaattcactctacaccatcagcagtctgcacgcctgtactgttattttacgacttaaactttattactcgtacctaaactagttaattaaaagttagtttaacgttaccggttaggtaaccgttagtttcgggaacccgtaaagggggaaccggtagggtaacgggaaaggttacgaaaacggtaacgtggtacggcttaggaacctacgacttactcgtttacgtctacgtttccccg

SEQ ID NO: 304675 - DNA, 484 bp, Homo sapiens
  misc_feature: GZ8MTXP02H91PT.9.75.G09.1.454.CMB.2.raw
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (370)..(375): a, c, t, g, unknown or other
  misc_feature (370)..(375): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcacatctcttgccgggcagtcagatgttcttagtggtgctggtntnagcaagaaaccgggaancccctaaatctgatctatgaggtcctntaggtttaacaaggtggggtccccatcaagattcgaggcggcagtgatcgtagggacagattcactcncacntcagcagtcnnnnnntntntnatatntacnacatatatatagtatcgtatactgtcgacgaggacgtaggtagaacgacgtaaacgacgtcgacgtcacgaacactacgtctcgtctactctcc

SEQ ID NO: 304676 - DNA, 565 bp, Homo sapiens
  misc_feature: GZ8MTXP02GSWJ9.9.75.G09.1.454.CMB.2.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctctgccgggccagtcagatgttcttagttggtgctggtatcagcagaaaccgggaanacccctaaactctgatctatgacggcctcgtggttaacaaaggtcggggtacccatacaaagtnttacgagcggcaggtcggatcgtgggactagtaacttcgactctacacctatcagcagtctgtacnctagtatgtatttgactaattatactgacctaactagtattaatagttactcgtagtaactagtttcggaaccgaaggggaccgtagggtacggaaacgtaacgaaacgtaacgtgggtacggtctacgcctaacctaagttcttacggttcttactacttcccttaccccgtacc

SEQ ID NO: 304677 - DNA, 578 bp, Homo sapiens
  misc_feature: GZ8MTXP02JZS6D.9.75.G09.1.454.CMB.2.raw
  modified_base (190)..(190): a, c, t, g, unknown or other
  misc_feature (190)..(190): n is a, c, g, or t
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggcagtcagatgttctagttggtgctggtatcagcagaaaccgggaanccctaaactcttagatctatgaggctctaggtttacaagtggggtcccatcaanacttcaggtcggcaggtggatcgtagggacagaacttcactctacacatcagcagtctgacacgcctgattgtatttcgactaacttattacncgtaccaactagtaattaagttagttactccggttagacttacgtttacggaccgtaaagggggaccgtagggtaacggaaacggttacgaaaaccgtagttacggtacgggacttacggaaccgtaacccgtacttaccgttggtttacccttaccgtcgtttacccccg

SEQ ID NO: 304678 - DNA, 667 bp, Homo sapiens
  misc_feature: GZ8MTXP02I1VSU.9.75.G09.1.454.CMB.2.raw
  modified_base (190)..(190): a, c, t, g, unknown or other
  misc_feature (190)..(190): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
tcagtgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtcctccttccaccctgtctgcatctggtggganacagagtccacatctcgtcggccgggcagtcagtattgttcttaggttggttggcctaggtatcgagacgaacgggaaaccgggaactacccctaaatcttagatacgtagtcggacgtccttgtaggtttaacgaagggtccgggtaccagtactaagtntacgagcggtataggtcgactcggaggaactagtaactccactcaccacatcagcgtagtcngtacgctagattgttaattcgtaacttaaacgtttataccgtacaacccgtaaaattaagttaaacgtttaaagtttaccggttaccgttaacggacggttaacgtttacggttaaccggggaaacggtaaacgggggaaccgtaaggggttaacggaaacgtaacgaaaacggtcgttaggtacggctaaccggcctaaccgttaagttccgttacgtttacctaccttaccgttcccgttacccgtttaacg

SEQ ID NO: 304679 - DNA, 818 bp, Homo sapiens
  misc_feature: GZ8MTXP02JT5FL.9.75.G09.1.454.CMB.2.raw
  modified_base (256)..(256): a, c, t, g, unknown or other
  misc_feature (256)..(256): n is a, c, g, or t
tcagtgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtcctccttccaccctgtctgcatctggtgggagacagagtcaccatctcttgccgggcagtcagtaattgttcttagttggttggcctggtancgagcgaacggaaaccggggaactacccctaaactcttagatactagtcggacggtccttagtaggtttaacgaaacggttcggggtaccccagtacgaaacgtacttaccgaggtcccgggactagggtcgggtaacttcggtaggggaactagggtaaacttccgtaacctttccaccgtaacccgtactacccgaaggtaccgtaacggttacgttacggaccgtaccggtacccgttagtaacgtttacggtttagtttttacgaaactttaaaaccgtttacttttaaacccggtacggttaacccctaaaacgttaagggtttaaaacttaaacgtttaaacggttttaacgttcccggggtttaaacggtaaaccggtttaacggtttaccggggaacccgggttaaaacggggggaaccccgggttaagggggtaaacgggttaaaaccgggttaaaccgtaaaaaccggggttaaccggttacggggtacgggttaaccgttaacgggaccctaaaccctttaagtcccggtttaaccgtttccgtttacccg

SEQ ID NO: 304680 - DNA, 425 bp, Homo sapiens
  misc_feature: GZ8MTXP01AYALM.25.41.D08.1.454.CMB.2.raw
  modified_base (419)..(425): a, c, t, g, unknown or other
  misc_feature (419)..(425): n is a, c, g, or t
tcagactgtacagtcacgaccggtgctcgatttagtcacgcgagaaagggaagggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaacccctggtcaccgtctcctcagcctccaccaagggcccatcggtctccccctggcgccctgctccaggagcacctccgagagcacacgcggcctgggctgccctggtcaaggctacttccactgtacagtctgagcgggctggcaaggcgcatagnnnnnnn

SEQ ID NO: 304681 - DNA, 521 bp, Homo sapiens
  misc_feature: GZ8MTXP01EQU9Q.25.41.D08.1.454.CMB.2.raw
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (509)..(513): a, c, t, g, unknown or other
  misc_feature (509)..(513): n is a, c, g, or t
  modified_base (515)..(521): a, c, t, g, unknown or other
  misc_feature (515)..(521): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaaatgaacagtctgagagccgaggacacggcggtgtattattgtgtaagaggctgtgatggggactgccaggtgttgactacgtggggccagggacccctggtcaccgtctccctcacgccctcccaaccgaaacgggccccagttccggtcccctttccccccgnggcccgcccctgcctcccgaggaccnccacccgtccgagacgccacgaccggccggtccgtgggcctcggacccgttcggtaaccgaaacggtacccttacccttacccacgttacggtactacgttcgtggacgggccggggcgtacgggacgaaacgggccgactaagagnnnnngnnnnnnn

SEQ ID NO: 304682 - DNA, 437 bp, Homo sapiens
  misc_feature: GZ8MTXP01AONMH.25.41.D08.1.454.CMB.2.raw
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (429)..(437): a, c, t, g, unknown or other
  misc_feature (429)..(437): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtggggccagggaaccctggtcaccgtcncctcagcctccaccaaggcccatcggtctccccctggccgccctgctccaggngcacctccgagagcacacgcggcctggggcctgcctggtcaaggcctacttccactgtacagtcctgagcggggctgggacaagggcgcaatagnnnnnnnnn

SEQ ID NO: 304683 - DNA, 461 bp, Homo sapiens
  misc_feature: GZ8MTXP01BC8VU.25.41.D08.1.454.CMB.2.raw
  modified_base (447)..(451): a, c, t, g, unknown or other
  misc_feature (447)..(451): n is a, c, g, or t
  modified_base (453)..(461): a, c, t, g, unknown or other
  misc_feature (453)..(461): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtggggccagggaccctggcaccgtctcctcagccctccaccgaacgggccccatccggtccttccccctggccgcccctgctcccgaggacgccacctccgagacgcacgcgccggcctggggctcgccctgggtcaaaggacctacttccacttgtacagtctgagccggggctgggcgaaggcgacaagtgnnnnngnnnnnnnnn

SEQ ID NO: 304684 - DNA, 435 bp, Homo sapiens
  misc_feature: GZ8MTXP02GZAAI.25.41.D08.1.454.CMB.2.raw
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (433)..(435): a, c, t, g, unknown or other
  misc_feature (433)..(435): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccaggtgttgactacgtggggccagggaaccctggtccaccgtctcctcagccctccaccgaacgggccccatccggtccttccccctggcccgcccctgcctcccgaggacgccaccgtccgaagacgcacacgccgccctgggctgcctgtcaagctactccatgtacagtctgagcggctggcaggcncanagnnn

SEQ ID NO: 304685 - DNA, 467 bp, Homo sapiens
  misc_feature: GZ8MTXP02I5Q03.25.41.D08.1.454.CMB.2.raw
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (450)..(467): a, c, t, g, unknown or other
  misc_feature (450)..(467): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaaagaacacggtggatctgcaaatgaacagtctgagagccgaggacacggcggtgtattattgtgtaagaggctgtgagtggggactgcctacggtgttgactacgtggggccagggaaccctggtcaccgtctcctcacgccctcccgaaccgaagggccccaagtccggttccttccccccgtggccgccccttggcctccaggtacgcaccctccgagcgcacaccgccgccctggctgccgtggtcaacggtctacttccatgacntctgaggtcggntggacaggcgtcagtagnnnnnnnnnnnnnnnnnn

SEQ ID NO: 304686 - DNA, 518 bp, Homo sapiens
  misc_feature: GZ8MTXP01CW72K.10.71.G05.1.454.CMB.2.raw
  modified_base (488)..(488): a, c, t, g, unknown or other
  misc_feature (488)..(488): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggccaggatatacaataatgaatgaacaagtaaaatataactatggagtactccttacaagggcccgattacaccatcctccagagacaattccgaaagaacatgtgtatctgacaatgaccagcctgagagccgaggacacgggttgtttanacgtgtagggaagaaagtcttagtggctaa

SEQ ID NO: 304687 - DNA, 526 bp, Homo sapiens
  misc_feature: GZ8MTXP01EU1L0.10.71.G05.1.454.CMB.2.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
  modified_base (496)..(496): a, c, t, g, unknown or other
  misc_feature (496)..(496): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaangccaccctctcctgcagggccagtcagagtgttcgcacttcgttagggtgtatcaacataaatccggcaggctcccaggctcctcatctttgatgctttcaacncgggcccctggcgtcccaggcaggttcagtggcagtgggtctgggacagaacttcnctctcaccatcagcagcctagacgcctagaagtattttgcttagtttatactgtcagcagggcgtgcctacgttcggcggaggtcgccgtacgttcgggacggagggaaccaaaagtagaggtacaaacgacgtgnggcttgcaccaatctgttcttcaacttccc

SEQ ID NO: 304688 - DNA, 650 bp, Homo sapiens
  misc_feature: GZ8MTXP01C836I.10.71.G05.1.454.CMB.2.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
tcagcatagtagtgcacgaccggtgctcgatttagtgtcgtcgcaagagagaggggaggagcccagcactagaagtcggcggtgcctccattcggtgatcagcactgaacacagaggactcaccatggagtttgggctgagcggtggtttcgctaggctctttaagagatgtccagtgtcagatgcagatggtggagtntgggggaggcgtggtccggccgtgggggtcccgtgagactctcctgtctgcgtctggtntntatnttataatctgctntcgtcgtcggtccgccgtacgtccgacggccgacggcgtaggtagtgggtggcgagtatatactaactatagtagtagaacgtaaaagtaaaataataacgtaagtacggtacgtaccgtaccgttacgtaacgggtaccgtacttacctacctactacctaccgtaacgtaacgtaactaaactaacctaaacgtaaacgtaacgttaggttaggttacgtacgtacgtaacgtaaacgtaacgaccgacgtaccgtacgtacgacggaccggacggtaacggtaacgggttaggtttagttacgtaggtagggttaaggttaacgttacgtaagtaggtaacgtacgtacgttacgttaacgttaacgttg

SEQ ID NO: 304689 - DNA, 589 bp, Homo sapiens
  misc_feature: GZ8MTXP01B50CY.10.71.G05.1.454.CMB.2.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcgtcgcaagagagaggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttaggggtgtatcaacataaatccggcaggctcccaggctctcatcttgatgctttcaacncgggcccctggctcccaggcagttgtngtcgcgtggtgtcgnggacaagtctcactccacactncgacgacacgtcgtagcgtcgtaagtaagttagtttcgacttagtttactacgtcgtacgacgtcgtacggtcggtccgtaccgttacggttccgggagggtacggtccgtaccgttaccggttacggggaccgggaacggaaaaccgtaaagttagggtaacgttaacgtaaacgtgttaggttcgacgtcgacctaactactgttcgttcttcgtc

SEQ ID NO: 304690 - DNA, 587 bp, Homo sapiens
  misc_feature: GZ8MTXP01EOXE9.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccacctctcctgcagggccagtcagagtgttcgctacttcggttaggggtgtatcaacataaatccggcaggctcccaggctcctcatctttgatgctttcaacacggcccctggccgtcccaggccaggttcaggtggctaggtggggtctggggactaggtaacctttcaacctctaccaccatccagcagccctagagtcctagaagttattttagcttaagttttacttacgtgtcaagtcgagggtcgttgtccctacgtttccggggcggtaggttcgaccgtacggtttcgggacgggaaggggaaaccctaaaagtgacgggtaacaaacgaacgtgttaggcttggccactaattctgttcttcgaacgttccc

SEQ ID NO: 304691 - DNA, 522 bp, Homo sapiens
  misc_feature: GZ8MTXP01EUFNT.10.71.G05.1.454.CMB.2.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccaggttccaggccgacgggctggatggggtgccagatatacaataatgntgaacagtaaatatactatgganactctcgaagggccattcaccatcctcagagaacaacttaccaaagaacatggtagtaatctagacaaatcgaccagcctgagacgccgaggactacgggttgtttcttacgtggtggaagtaaatccgttagtggctaag

SEQ ID NO: 304692 - DNA, 528 bp, Homo sapiens
  misc_feature: GZ8MTXP01C4Y53.10.71.G05.1.454.CMB.2.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
  modified_base (524)..(524): a, c, t, g, unknown or other
  misc_feature (524)..(524): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctcccaggctcctcatctttgatgctttcaacagggcccctggcgtcccaggcaggttcagtggcagtggggtctggggacagaacttcnctctcaccatcagcagcctagagcctgaagtattttgctagtttattactgtcagcaggcgtgcctacgtttcggcggaggtcgacctacgtttcgggacggacgggaccaaaagtgaaggtacaaacgaacgtgttaggcttgcacaatctgttcttcnttcc

SEQ ID NO: 304693 - DNA, 603 bp, Homo sapiens
  misc_feature: GZ8MTXP01EMA6D.10.71.G05.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaancgccaccctctcctgcagggccagtcagagtgttcgctacttcgttagggtgtatcaacataaatccggcaggctcccagctcctnatctttgatgctttcaacgcggcccctggccgtcccaggcaggttcagtggcaggtggtctgggacagtaacttcaactctcaccatcagcagcctagagcctagaagtattttgactagtttatactgtcagtcagggtcgtcgcctacgtttcgggcggtacggtcgacccgtacggtttccggggacgggaacgggtaaacctaaaaagtacggaaacgggtaaccgaaaacggtaaccgtaggttacgggcttacggaacccacccgttaattccgttacggttcctttaaccgttaaccgttttccccg

SEQ ID NO: 304694 - DNA, 524 bp, Homo sapiens
  misc_feature: GZ8MTXP01B1NG4.10.71.G05.1.454.CMB.2.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
  modified_base (519)..(519): a, c, t, g, unknown or other
  misc_feature (519)..(519): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctcccaggctctcatctttgatgctttcaacagggcccctggcgtcccaggcaggttcagtggcagtgggtctgggacagaacttcnctctcaccatcagcagcctagagcctgaagtattttgctagtttattactgtcagcaggcgtgccacgtttcggcggtaggtcgcctacgtttcggcggtagggaaccaaaagtacgaggtacaaacgaactgttggcttgcaccaatctgttcttcnttccc

SEQ ID NO: 304695 - DNA, 528 bp, Homo sapiens
  misc_feature: GZ8MTXP01EEFF4.10.71.G05.1.454.CMB.2.raw
  modified_base (202)..(202): a, c, t, g, unknown or other
  misc_feature (202)..(202): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttagggtgtatcaacataaatccggcaggctcccaggctcctcatctttgatgctttcaacagggcccctggcgtcccaggcaggttcaggtgcaggtggtctgggacngaacttnaactctcaccatcagcagcctagagcctagaagtattttagctagtttatactgtcagcaggtcgtgcctacgtttcggcggtaggtcgcctacgttcgggacggagggaaccaaaagtagaggtacaaagacgtgttggcttgcacntctgttcttcaacttccc

SEQ ID NO: 304696 - DNA, 604 bp, Homo sapiens
  misc_feature: GZ8MTXP01CW7AC.10.71.G05.1.454.CMB.2.raw
  modified_base (204)..(204): a, c, t, g, unknown or other
  misc_feature (204)..(204): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaanagccaccctctcctgcagggccagtcagagtgttcgctacgtttcggttaggggtgtatcaacataaatccggcaggctcccagctcctcattctttgatgtctttacaacgtcgggcccctgggccgtcccaggcctaggttcaggtggcaggtggggtctggggacagtaaccttcaactctacacctatcagcagcctagngctgaagtntttagcttagtttactacgtgtcagcaggtcgtgcctacgttcgggcggtaggtcgtaccgtacgttccggggacggtaacgggaaacctaaaaagtacggttaacgggtaacaaaacggtacgtaggttcggccgttacggaacctaccgtaacttccgtcgttaccttcccgttaactttccccg

SEQ ID NO: 304697 - DNA, 523 bp, Homo sapiens
  misc_feature: GZ8MTXP01DZ1ME.10.71.G05.1.454.CMB.2.raw
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcattctttagtaaatctggcatgtcctgggtccncaggttccaggccacgggctggaatggggtggccagatatacaataatgaatgaacaagtaaaatatactatgagactccttanaagggccattcacatcnccaganaacaattccaaagaacaagtggtagtatctgacaaatgaccagcctaagagagccgaggaccgagggttgtttattacgtgtagggaagtaaatcgttagtggctaag

SEQ ID NO: 304698 - DNA, 573 bp, Homo sapiens
  misc_feature: GZ8MTXP01D9EWW.10.71.G05.1.454.CMB.2.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacttcggttagggtgtatcaacataaatccggcaggctccaggctcctcatcttgatgtctttcaacacgggcccctggccgtcccaggcaggttcagtgcaggtggtctgggacagtacttcnctctacaccatcagcagcctagacgtcctagtaagtattttagacttagtttattacgtgtcagtcagggtcgtgcctacgtttcggcggtaggtcgccgtacgtttcgggacggtaacgggaaccaaaagttaggaacggtaacaaaacggtaacgtggttcggttcttagcctacctaattctcgttcttcgttaacgtttccccg

SEQ ID NO: 304699 - DNA, 547 bp, Homo sapiens
  misc_feature: GZ8MTXP01AQHDU.10.71.G05.1.454.CMB.2.raw
  modified_base (382)..(382): a, c, t, g, unknown or other
  misc_feature (382)..(382): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcggtggtccggccgtggggggtccctgagactctcctgttctgcgtctggattcattctttagtaaatctggcatgtcctgggtcccgcaggttccagggcccacgggctggaagtggggtggccaggatatacaataatgaatgaacaagtaaaatntactatggagactccttacgaagggccattacacctatcctacagagaactaattacccgaaagaacataggtgtatcagacaaatcgaccagcctaagagacgccgaggacctacggggttgtttagttacgtggtaggaagtaactccgttagtcggctaacg

SEQ ID NO: 304700 - DNA, 565 bp, Homo sapiens
  misc_feature: GZ8MTXP01D0XJC.10.71.G05.1.454.CMB.2.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgttcgctacttcgttaggggtgtatcaacataaatccggcaggctcccagctcctcatctttgatgtctttcaacgacgggccccctgggccgtcccgaggctaggttcaggtggcaggtgggtctggggacagtacttcnctctcaccntcagcagcctagcnctagaagtatttagacttagtttattactgtcagcgaggtcgtcgtcctacgtttcgggccggtaggtcgacccgtacgttcgggacggtacgggaaccaaaagtaggaggtaacaaacggtaactggttacggcttcgcacctaattctgttcttcgctttcccg

SEQ ID NO: 304701 - DNA, 531 bp, Homo sapiens
  misc_feature: GZ8MTXP01BRQPJ.10.71.G05.1.454.CMB.2.raw
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtggggggtccctgagactctcctgttctgcgtctggattcatctttagtaatctggcatgtcctgggtcccgccaggttccaggccacgggctggatggggtggcagatatacaatatgatgacaagtaaaatntactatggagactctnaagggcatcacatctcaganacaatccaagacatggtgtatctgacaaatgaccagcctgagacgcccgagggaactacgggttgtttaattacgtggttggggaagttaaagttcccgtaaggtgggctaacgtccgaccttgggttaactttgggg

SEQ ID NO: 304702 - DNA, 547 bp, Homo sapiens
  misc_feature: GZ8MTXP01EXBMH.10.71.G05.1.454.CMB.2.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaangccaccctctcctgcagggccagtcagagtgttcgcacgttcgttaggggtgtatcaacataaatccggcaggctcccaggctcctcatctttgatgtctttcaacgcggcccctggcctcccaggcaggttcaggtggcaggtgggtctggggacagtacttcnctctcaccatcagcagcctagacgctagaagtattttgcttagtttattactgtctagcagggtcgtcgtcctacgtttcgggccggtaggttcgcctacggttcgggacggacgggaaccaaagtggaggtacaaacggacgtggttggcttgcaacnttctcgttacttcaacttcccg

SEQ ID NO: 304703 - DNA, 597 bp, Homo sapiens
  misc_feature: GZ8MTXP01EFP7Q.10.71.G05.1.454.CMB.2.raw
  modified_base (202)..(202): a, c, t, g, unknown or other
  misc_feature (202)..(202): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgctacgttcgttagggtgtatcaacataaatccggcaggctccagctctcatcttgatgtctttcaacgacgggcccctggccgtcccaggctaggttcaggtggctaggtgggtctggggacagtaaccttcnctctcaccatcagcagcctagacgctagaatattttgacttaagtttattacgtgtactagcgtaggtcgtcgtccctacggtttccgggacggtacggtcgtacccgtacgtttccgggacgggtaacgggaaacctaaaaagtacggacggtaacaaaacggtaacgtggttacggcttacggcctaacctaagttcgtacgttccttccgttaactttccccg

SEQ ID NO: 304704 - DNA, 516 bp, Homo sapiens
  misc_feature: GZ8MTXP01AJXM0.10.71.G05.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (504)..(504): a, c, t, g, unknown or other
  misc_feature (504)..(504): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctntcctgcagggccagtcagagtgttcgctacttcgttagggtgtatcaacataaatccggcaggctcccaggctcctcatctttgatgctttcaacnggcccctggcgtcccaggcaggttcagtggcagtggtctggggacagaacttcnctctcaccatcagcagcctagancctgaagtatttgctagtttatactgtcagcaggcgtgcctacgtttcggcggaggtcgcctacgtttcggcggagggaccaaaagtgaggtacaaacgactgttaggcttgcaccaatcngttctcaatccc

SEQ ID NO: 304705 - DNA, 508 bp, Homo sapiens
  misc_feature: GZ8MTXP01C0BZX.10.71.G05.1.454.CMB.2.raw
  modified_base (353)..(353): a, c, t, g, unknown or other
  misc_feature (353)..(353): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggcctggggggtccctgagactctcctgttctgcgtctggattcatcttagtaatctggcatgtcctgggtccgccaggttccaggccacgggctggaatgggtggcagatatacaatatgatgacaagtaaatntactatggagactcttcaagggccattcacatctaccagacacaattccaaagaacatggtgtatctgacaaatgaccagcctgagagccgaggaacacgggttgtttattacgtgtggggagaattccgtaagtggcatcacctgggttcttgg

SEQ ID NO: 304706 - DNA, 528 bp, Homo sapiens
  misc_feature: GZ8MTXP01AYUIN.10.71.G05.1.454.CMB.2.raw
  modified_base (198)..(198): a, c, t, g, unknown or other
  misc_feature (198)..(198): n is a, c, g, or t
tcagcatagtagtgcacgaccggtgctcgatttagtgtcgtcgcaagagagagggggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttagggtgtatcaacataaatcgacaggctccagctcctcatctttgatgctttcaacagggcccctggcgtcccaggcaggttcagtggcagtcgggtctggggacagacttcactctcaccatcagcagccctagagcctgagtatttgctagtttatactgtcagcagcggtgcctactttcggcggaggtcgccgtacgtttcggcggacgggaccaaaagtaaggacggttacgaaacgaacgtggtaggcttggcaaccatctgtcttctaacttcttcccg

SEQ ID NO: 304707 - DNA, 537 bp, Homo sapiens
  misc_feature: GZ8MTXP01ESUII.10.71.G05.1.454.CMB.2.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (531)..(531): a, c, t, g, unknown or other
  misc_feature (531)..(531): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgctacttcgttagggtgtatcaacataaatccggcaggctcccaggctcctcatctttgatgctttcaacngggcccctggcgtcccaggcaggttcagtggcagtgggtctgggacagaacttcnctctcaccatcagcagccctagacgcctagaagtattttgctagtttattactgtcagcaggcgtcgcctacgtttcggcggaggtcgccgtacgtttcgggacggtacgggaaccaaaagtggaggtacaaacgtacgtggttaggcttgcaccaatctgttcttcnttcccg

SEQ ID NO: 304708 - DNA, 577 bp, Homo sapiens
  misc_feature: GZ8MTXP01DWO53.10.71.G05.1.454.CMB.2.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggtagggtgtatcaacataaatccggccaggctcccaggctcctcatctttgatgtctttacaacgacggggccccctggccgtcccaggcaggttcaggtggcaggtgggtatgggacagaacttcaactctcacatcagcacgcctagancctagaagtattttagcttagtttatactgtcagcaggcgtgcctacgtttcgggcggaggtcgcccgtacgttcgggacgggtaagggaaccaaaagtcggaggttaaccaaaacgtaacgtggttacgggcttcggtaaccaacctaagttcctacgttcctttccgaactttccccg

SEQ ID NO: 304709 - DNA, 624 bp, Homo sapiens
  misc_feature: GZ8MTXP01DZ3X6.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtcctgagctctcctgttctgcgtctggattcattctttagtaaatctggcatgtccgtcgggtccgcctaggttccagggcccacgggggctggaatggggtgccagatatacaataatgaatgaacaagtaaaatatactatgggatactccttacgaagggtcctaattccaactatcctaccaagaacgaacaaacgtttacccaaaggtaaacctagttagggtagtaaactccgttaggaacctaaaattccggaaccctacgaccctaagggaaacgacggaccccggaaagggtaaccgttaaccgggggtttagttttagttaaccgttggggtaggggtaaacgtaaagtcccgttaaggtcgggaacttaaccg

SEQ ID NO: 304710 - DNA, 517 bp, Homo sapiens
  misc_feature: GZ8MTXP01E34W6.10.71.G05.1.454.CMB.2.raw
  modified_base (307)..(307): a, c, t, g, unknown or other
  misc_feature (307)..(307): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtggggggtccctgagactctcctgttctgcgtctggattcattctttagtaaatctggcatgtcctgggtccnccaggttccaggccacgggctggaatggggtgccagataatacaataatgaatgaacaagtaaaatatactaatggagactccttacgaagggccattcacatctcaganacaattccaaagaacataggtntaatctagacaaatgaaccagcctgagagccgagacgtacgggttgttattatggngggaanaaatccttagtgctaa

SEQ ID NO: 304711 - DNA, 671 bp, Homo sapiens
  misc_feature: GZ8MTXP01EV6RR.10.71.G05.1.454.CMB.2.raw
  modified_base (202)..(202): a, c, t, g, unknown or other
  misc_feature (202)..(202): n is a, c, g, or t
  modified_base (385)..(385): a, c, t, g, unknown or other
  misc_feature (385)..(385): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggcaggctcccaggctctcatctttgatgtctttcaacacgggcccctgggccgtccccgaggtcaggttcaggtggctaggtgggtctggggacaggaacttcgaactctcaccntcagcagccctagacgcctagaacgtattttacggacttaaggttttacttaactggtacctaaggtccaagggggtccggtttcgaccccgttaacggttttccggggccgggtaacgggttcggtacccgttaaccggttttccggggacggggtaaacggggaaacccgtaaaaaggttacgggaaacggtaacgaaaacggtaaccgttagggttacgggttccgttacgaacccgtaaccgtaacttccgttacggttcctttaacttaaccgtttccccg

SEQ ID NO: 304712 - DNA, 567 bp, Homo sapiens
  misc_feature: GZ8MTXP01A5P1F.10.71.G05.1.454.CMB.2.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtggggggtccctgagctctcctgttctgcgtctggattcatctttagtaatctggcatgtcctgggtcccgccaggttccaggcccacgggctgggaatggggtggcagatatacaatatgatgaacaaagtaaaatntactatgganactccttagaacgggcctattcacatctccagagactaatccaagaacatggtagtatctagacaaatcgaaccagccctgagacgcccggaaggaacctaacggggttgttttaattacgtgggtaggggaaagttaacgttccgtaagggtcggtaacctagttcccgaccgttgggttaattttccgggg

SEQ ID NO: 304713 - DNA, 641 bp, Homo sapiens
  misc_feature: GZ8MTXP01DYTQM.10.71.G05.1.454.CMB.2.raw
  modified_base (204)..(204): a, c, t, g, unknown or other
  misc_feature (204)..(204): n is a, c, g, or t
  modified_base (377)..(377): a, c, t, g, unknown or other
  misc_feature (377)..(377): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttagggtgtatcaacataaagtccggcaggctccagctcctcatctttgatgtctttacaacgacgggcccctggccgtcccaggctaggttcaggtggctaggtgggtctggggacaggtaaccttcnctctcaaccatcagcagcctagacgtcgtagaagttattttagcttagtttactacgtgtaccagtcgacggggtacgttcgtcccgttacggtttccgggacgggtacggttcgtacccgttacggtttccggggacgggtaaacgggtaaacccgtaaaaaggtcgggaaacgggttaaaccaaaacgggtaaccgtggttacgggcgttacggaaccctaactaacgtttcgtcgttccttaacgttaaccgtttcccccg

SEQ ID NO: 304714 - DNA, 535 bp, Homo sapiens
  misc_feature: GZ8MTXP01CHJJL.10.71.G05.1.454.CMB.2.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtggggggtccctgagctctcctgttctgcgtctggnttcattctttagtaaatctggctatcgtcctgggtcccncaggttccagggccacgggctggaagtggggtgccagatatacaataatgntgaacaagtaaaatntactatgagacttccttcgaagggcctattccaccatcctaccagagacaaacttaccgaaagaacagtaggtgtatctgaccaaatcgaccagcctgaagngccgaggacgtcgggttagttnttacgtggtgggaataactccgttaggtggctaac

SEQ ID NO: 304715 - DNA, 558 bp, Homo sapiens
  misc_feature: GZ8MTXP01CI0C7.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgagactctcctgttctgcgtctggattcatctttagtaaatctggcatgtccgtgggtcccgccaggttccagggccacgggctggaatggggtgccaggatatacaataatgaatgaacaagtaaaatatactatggagtactccttacgaagggccgattcacctatcctaccaagaacgaactaacttaccgaaagaaacctagtaggtagtatcctagaccaaatcgaacctagcctgaagacggaccgaggtacgtacggggttagtttattacgtggtagggtaagaatccgttagtcggcttaacg

SEQ ID NO: 304716 - DNA, 584 bp, Homo sapiens
  misc_feature: GZ8MTXP01AKSIW.10.71.G05.1.454.CMB.2.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgagggaangccaccctntcctgcagggccagtcagagtgttcgctactttcggttaggggtgtatcaacataaatccggccaggctcccaggctcctcatctttgatgtctttacaacgacgggcccctggccgtcccaggcaggttcagtggcgttttaggngggtctggggacaggtaaccttcnctctcaccatcagcagcctagacgcctagaagtattttgcttagtttattactgtcagtcagggtcgtcgcctacgtttcgggcggtaggtcgtaccgtacggtttccgggacgggtaaacgggaaccaaaagttacggaacggtaacgaaacggtaaacgtggttcggcttcggaacaccgtaatctgttcttcgaacgttccc

SEQ ID NO: 304717 - DNA, 540 bp, Homo sapiens
  misc_feature: GZ8MTXP01BHOQ6.10.71.G05.1.454.CMB.2.raw
  modified_base (385)..(385): a, c, t, g, unknown or other
  misc_feature (385)..(385): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggccgtggggggtccctgagactctcctgttctgcgtctggattcatctttagtaaatctggcatgtcctgggtccgccaggttccaggccacgggctggaatggggtgccagatatacaataatgaatgaacaagtaaaatataactatagganactccttacgaagggccgattaccacctatcctaccagagaacaacttccaaagtaacagtggtagtatctagacaaatgaccagcctaagacgcgccgaggacgtacgggttgttagttacgtggtagggaagaaatccgttagtcggctaacg

SEQ ID NO: 304718 - DNA, 536 bp, Homo sapiens
  misc_feature: GZ8MTXP01A2ZEV.10.71.G05.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccagggaaangccacctntcctgcagggccagtcagagtgttcgcacttcgttagggtgtatcaacataaatccggcaggctcccaggctcctcatctttgatgctttcaacacgggcccctggcgtcccaggcaggttcagtggcaggtgggtctgggacagaacttcnctctcaccatcagcagcctagacgtcctagaacgtattttgctagtttatactgtcagcaggtcgtgcctacgtttcgggcggtaggtcgcctacgtttcgggacggtacgggaaccaaaagtagaggtacaaacgtacgtggcggcttggcacaattctgttacttcaattcccg

SEQ ID NO: 304719 - DNA, 721 bp, Homo sapiens
  misc_feature: GZ8MTXP01CG583.10.71.G05.1.454.CMB.2.raw
  modified_base (714)..(714): a, c, t, g, unknown or other
  misc_feature (714)..(714): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggttttcctcgttgctcttttaagagatgtccagtgtcagatgcagatgggtggagtcgtgggggaggcggtggtccggccgtgggggtccctgacgctctcctgttctgcgtctggattcattctttaagtaaatctggctagtcgtccgtggggtccccgaccgtacgggttcccacgggtcccgaacgggggtccgtaggggaaacgtgggggtacggaccccgtaaggtattaataaccgtaaaagttaaagttaggtaagttaggtaaaaccgtaaaagggtttaaaaaaattaacgttaaaccgttaaagtacggggtaaacggttaacctttccccggtttaacggaaacgggggtaccctaacgtttacccaaccctaaattccctaacccgaagtaaacgaacctaaacgtttacccgaaaagtaacgtagttagggtattaactcgtagaaccaaaagtcgaacctagccgtaaggacgacggcccgaagggaccgtgggttagtttacgttacggtgggtagggaactaaacgtccgttaggttcgnttaaccg

SEQ ID NO: 304720 - DNA, 595 bp, Homo sapiens
  misc_feature: GZ8MTXP01AGPAX.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcatctttagtaaatctggcatgtcctgggtccgcaggttccaggcccacgggctggaatggggtgccagatatacaataatgaatgaacaagtaaaatatactagtaggagtactaccttacgaaggggcccaattccacctatacctacccgaagaacaacctaaacttacccgaaagtaaaccgtattgggtagtaactcgtacgaaccaaatcggaaccaacggccctaaggaacgacggacccgaagggaccgtaacgggttgttttaagttacgtgggttaggaacgtaaaacgtccgttagttcggaacgtaacg

SEQ ID NO: 304721 - DNA, 530 bp, Homo sapiens
  misc_feature: GZ8MTXP01DLFQ1.10.71.G05.1.454.CMB.2.raw
  modified_base (445)..(445): a, c, t, g, unknown or other
  misc_feature (445)..(445): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggccgtggggggtccctggagactctcctgttctgcgtctggattcatctttagtaaatctggcatgtcctgggtccgccaggttccagggccacgggctggaatggggtgccagatatacaataatgaatgaacaagtaaaatatactatagggatactccttagaagggccattacaccatcctaccagagacaattccaaagaacatgggtntaatctagacaaatgaccagcctgagacgccgaggaccaggggttntttattacgtggtaggaataaatccgttagtcggctaag

SEQ ID NO: 304722 - DNA, 541 bp, Homo sapiens
  misc_feature: GZ8MTXP01A1A4B.10.71.G05.1.454.CMB.2.raw
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatcttagtaaatctggcatgtcctgggtccgccaggttccaggccacgggctggaagtgggtggcagatataccaatatgatgaaacagtaatatactatggagactctcaagggcattcacatcgtaccaganacattaccaagacatggggtntaatctgactaaacncgacagctagacgacgacgaaggtacgttagggtttatttagttacgtggttacggaagttaacgtccgtaggtcgactacgttaccgtaacgttggttaag

SEQ ID NO: 304723 - DNA, 563 bp, Homo sapiens
  misc_feature: GZ8MTXP01BBBFD.10.71.G05.1.454.CMB.2.raw
  modified_base (361)..(361): a, c, t, g, unknown or other
  misc_feature (361)..(361): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcattctttagtaaatctggcatcgtccgtggggtccgccgtaggttccacgggccacggggctggaatggggtgccagatatacaataangaatgaacaaagtaaaatataactatggaacgtactcccgttagaaacggggtcctaatttaccaacctatcctaccaagaacgaactaaacttacccgaaagtaactagtgggtatatctagacaaatcgaccagcctgagacgccgaggacgtacgggttgtttattacgtggtaggtaagaactcgttagtcgcgtaac

SEQ ID NO: 304724 - DNA, 570 bp, Homo sapiens
  misc_feature: GZ8MTXP01CZ8RA.10.71.G05.1.454.CMB.2.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgctacttcggttaggggtgtatcaacataaatccggccaggctcccaggctcctcatctttgatgctttcaacagggcccctggcgtcccaggcaggttcagtggcaggtgggtctggggacagtaacttcnctctcaccatcagcagcctagagcctgaagtattttgctagttttattactgtcagtcagggtcgtgccctacgtttcggcgggaggtcgccctacgtttccgggcgggtaacgggacctaaaagtacggaggtacaaacggtaaacgttggttacgggcttcgggaaccaccctaattctagttccttcaacgtttccccg

SEQ ID NO: 304725 - DNA, 556 bp, Homo sapiens
  misc_feature: GZ8MTXP01DM8DG.10.71.G05.1.454.CMB.2.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (535)..(535): a, c, t, g, unknown or other
  misc_feature (535)..(535): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaancgccacctctcctgcagggccagtcagagtgttcgctacttggttaggggtgtatcaacataaatccggcaggctccaggctcctcatcttgatgctttcaacgcgggcccctggcctcccaggctaggttcaggtggctaggtgggtctggggacagtaaccttcnctctcaccatccagcagcctagacgctagtaagtattttgacttagttttatactgtcagtcagggtcgtgtcctacgttcgggcggtaggtcgaccgtacgttcgggacggtacgggaaccaaaagtgaacggtacaaacgtacgtgttacggcttagccactnttctcgttcttcaacgttccc

SEQ ID NO: 304726 - DNA, 602 bp, Homo sapiens
  misc_feature: GZ8MTXP01A1UQU.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtgggggtcctgagctctctgttctgcgtctggattcatctttagtaaatctggcatcgtcctgggtacccgcctaggttccaggccacggggctggaatggggtgcagatatacaataatgaatgaacaagtaaaatataactatggaagtactccttacgaacgggtccgtattaccacctatcctaccagacgaacaacttaccaaagaactatacgggtattactcttagactaaaacttcggaaacccaggtacccttaaggaacggacggaccccgaaaggggtaaccgtaacggggttagttttaacgttaccgttgggtagggtaagtaaaactccggttaaggttcggaacccttaag

SEQ ID NO: 304727 - DNA, 581 bp, Homo sapiens
  misc_feature: GZ8MTXP01B9123.10.71.G05.1.454.CMB.2.raw
  modified_base (317)..(317): a, c, t, g, unknown or other
  misc_feature (317)..(317): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttacttttaagagatgtccagtgtcagatgcagatggtggagtcgtgggggaggcggtgggtccggccgtcggggggtccctggacgactctcctgttctgcgtctggattcattctttagtaaatctggcatgtcctgggtcccncaggttccagggcccacggggctgggaagtggggtggccaggatataacaattaatgaatagaaactaaagttaaaaatataactaatgggaatacttaccttacgaacgggtccgtatttacccaacctaatcctacccagaacgtaacaacttaccgaaagtaactagtggtatatctagacaaatcgaccagctaagagcgcgaggacgtacgggttgtttattacgtggtagggaagtaacttccgttagtcggctaacg

SEQ ID NO: 304728 - DNA, 592 bp, Homo sapiens
  misc_feature: GZ8MTXP01EKOB7.10.71.G05.1.454.CMB.2.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgctacttcgttagggtgtatcaacataatccggcaggctccagctcctcatcttgatgtctttcaacacgggcccctgggccgtcccaggcaggttcaggtggcaggtgggtctggggacaggtaacttcnctctacaccatcagcacgccctagacgcctagaagttattttggacttaagtttacttactgttcagtcagggtcgtcgccgttacgtttcgggcggtaggtcgaccgttacgtttccgggacgggtaacgggaacctaaaagtaggaacgggtaacaaacggtaacgtggttacggcttcggaacctaccctaattctgttaccttcttaacgtttccccg

SEQ ID NO: 304729 - DNA, 311 bp, Homo sapiens
  misc_feature: GZ8MTXP01A4UU5.10.71.G05.1.454.CMB.2.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (308)..(311): a, c, t, g, unknown or other
  misc_feature (308)..(311): n is a, c, g, or t
tcagcatagtagtgcacgaccggtgctcgatttagtgtcgtcgcaagagagaggagggggggctgggaggcctttgttggagaccttgcacttgtactccttgccgttcagccagtcctggtgcacgacggtgaggacgctgaccacacggaacgtgctgttgaactgctcctccgtggtcaccgtctctcgcctccacaggccatcgtctcccngcncctgctcaggancacctcgagagcacagccgcctgggctgcctggcaaggctactccatactatgctgacgcggctggcaaggcncatgnnnn

SEQ ID NO: 304730 - DNA, 524 bp, Homo sapiens
  misc_feature: GZ8MTXP01EJYJB.10.71.G05.1.454.CMB.2.raw
  modified_base (354)..(354): a, c, t, g, unknown or other
  misc_feature (354)..(354): n is a, c, g, or t
  modified_base (459)..(459): a, c, t, g, unknown or other
  misc_feature (459)..(459): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggtttcctcgttgctcttttaagagatgtccagtgtcagatgcagatggtggagtcgtgggggagcgtggtccggccgtgggggtccctgagactctcctgttctgcgtctggattcatctttagtaaatctggcatgtcctgggtccgcaggttccaggccacgggctggaatggggtgccaggatatacaataatgntgaacaagtaaaatataactatggagtactccttcaagggccattcacatctccagagacaattcaaagaacatggtgtatctgacaaatcgaccagcctggagngccgaaggacgacggggttgtttattacgtggtaggggaagtaaagtccgttaagtcggctaacg

SEQ ID NO: 304731 - DNA, 768 bp, Homo sapiens
  misc_feature: GZ8MTXP01ET4A9.10.71.G05.1.454.CMB.2.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaancgccaccctctcctgcagggccagtcagagtgttcgctacgtttcgttaggggtgtatcaacataaatccggcaggctccaggctctcatcttgatgtctttacaacgacgggccccctgggccgtccccgaaggtcctaaggtttcaaggtcggcgtaggttcggggtctggggactaggtaacctttccaacttctaccaaccctattccaaggcacgtaccctaaggacgtaccgtaggtaaacgttaagttttttacggactttaaggtttttaactttaaccgttgttaccgaaggtaccgtaaacgggggtccggtttacggtaccccgtttaaaccggttttccgggggaacccggggtagggttccggaccccgtttaaccggttttccggggaccgggggtaaacgggaaacccgtaaaaaaggtttaacgggaaacggggttaaacccgttaaaaccggtaaaccggttagggttacgggttccgttacgggaaccccgtaaccgtaactttcgttaccggtttcctttaacccgttaaccgttttaaccccg

SEQ ID NO: 304732 - DNA, 623 bp, Homo sapiens
  misc_feature: GZ8MTXP01AJ9CC.10.71.G05.1.454.CMB.2.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaancgccaccctctcctgcagggccagtcagagtgttcgctacgtttcggttagggtgtatcaacataaatccggcaggctcccaggctcctcattctttgatgtctttcgaacgacgggcccctggccgtcccaggctaggttcaggtggcaggtgggtctgggacagacttcnctctcacntcagcagcctagacgctagaagtatttgacttagtttatactgtacagcgaggtcgtcgtccgtacggtttcgggcggtacggtcgtacccgtacggtttccgggacgggtaacggggaaccctaaaaaggtacgggaaacgggtaaaccgaaaaccgggtaaccgttagggttacggttcgttaccggaaccgtacccgtaactttccgttcgtttaccctttccgttaacgtttccccg

SEQ ID NO: 304733 - DNA, 591 bp, Homo sapiens
  misc_feature: GZ8MTXP01A17YJ.10.71.G05.1.454.CMB.2.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgctacttcggttagggtgtatcaacataatccggcaggctccagctctnatcttgatgctttcaacncgggcccctggccgtcccaggctaggttcaggtggcaggtgggtctggggacagtaacttcnctctcaccatcagcacgcctagagcctagaagtattttgacttagtttatactgtcagtcagggtcgtcgcctacgtttcgggcggtaggtcgtacccgtacgtttccggggacggtaacgggaacctaaaagttacggaacgggttaccaaaacggtaaacgtggttacggcttcggaaccaccgtaattccgttcggttacctttccgttaacgtttccccg

SEQ ID NO: 304734 - DNA, 550 bp, Homo sapiens
  misc_feature: GZ8MTXP01DYDXT.10.71.G05.1.454.CMB.2.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (522)..(522): a, c, t, g, unknown or other
  misc_feature (522)..(522): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctccccagacaccaccggagaaattgtgttgacacagtctccagccacgctgtctttgtctccaggggaanacgccaccctctcctgcagggccagtcagagtgttcgctacttcgttagggtgtatcaacataaatccggcaggctcccaggctcctcatctttgatgctttcaacaggcccctggcgtcccaggcaggttcagtgcagtggtctggacngaacttcnctctcaccatcagcagcctagacgtctgaagtactttgactagtttatactgtcagtcaggtcgtgcctacgtttcggcggaggtcgaccgtacgttcgggacggaagggaccaaaagtcggaggtacaaacgaaaccgttgacgggcttggaacctaccnttcctgttcctttaacgcgtttaacccc

SEQ ID NO: 304735 - DNA, 629 bp, Homo sapiens
  misc_feature: GZ8MTXP01DKF5U.10.71.G05.1.454.CMB.2.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtctccaggagaaagngccaccctctcctgcaggccagtcagtagtgttcgctacgttcggttaggggtgtatacaacataaactccggcaggcctcccgaggcctcctcattctttgatgtctttacaacgtcgggcccctggcccgtcccgaggctaggttcaggtggccgaggtgggtcgtggggacaagtacttcactcctacacctatcagcacgcctaggacgctgaaagttattttgacttagtttattacgtgttacagtcgagtcgtagtcccgtacgtttcgggcggtaggtcgtccgtacggtttcgggacgggtaacggggaaacctaaaggttacggaacggttaaaccgaaaacgggtacgttacgggttcgggaccgttaacggaccctaaccgttacttccgttacgtttcctttcgttaacccg

SEQ ID NO: 304736 - DNA, 563 bp, Homo sapiens
  misc_feature: GZ8MTXP01CNQTW.10.71.G05.1.454.CMB.2.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
  modified_base (383)..(383): a, c, t, g, unknown or other
  misc_feature (383)..(383): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgcttgtctttgtctccgaaggggaaanacgccaccctctcctgcagggccagtcagagtgttcgctacttcggttaggggtgtatcaacataaactccggcaggctcccaggctctnatctttgatgtctttacaacgacgggcccctggccgtcccgaggctaggttcaggtggctaggtggggtctggggacagtaaccttcnctctcaccatcagcagctagagctagaagtatttgactagtttattactgtcagcaggtcgtgcctacgttcggcggtagtcgccgtacgttcgggacggtacgggaaccaaaagtagaggtacgaaacgtaacgtgttacggcttacgcaccgtcttactgttcttcgttaacttcccg

SEQ ID NO: 304737 - DNA, 607 bp, Homo sapiens
  misc_feature: GZ8MTXP01EHFIX.10.71.G05.1.454.CMB.2.raw
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtgtggggagcgtggtccggcgtgggggtcctgagactctcctgttctgcgtctggattcatcttagtaaatctggctatgtcctcggtccgcaggttccaggccgacgggctggaatgggngccagatatacataanantagaaactaagtaaaattactaactagtacgggacgtacttccttacgaaagggtccgaatttaccaaccctatccctacaacgaacgtaacctaaacgtttaccaaaaggtaaacctaagttgggtagttaactccttaggaacctaaatcgaaccctagcccgtaagcgacggtaccgaagggacgtaacggggttgtttacgttaaccgtgggttaaggggtaataaaacgttccgttaagggtcggctaacg

SEQ ID NO: 304738 - DNA, 635 bp, Homo sapiens
  misc_feature: GZ8MTXP01AKM1X.10.71.G05.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgagggaaangccaccctntcctgcagggccagtcagagtgttcgctacgttcggttagggtgtatcaacataaactccggcaggctcccaggctcctnattctttgatgtctttcgaacgcgggcccctggccgtcccgaggcaggttcaggtcggctaggtgggtctggggacacgtaaccttcaactctccactatcagcacgcctagacgtcctaggtaacttntttagacttaggttttacttacgtgtaccgagtacgacggggtcgtcggtacccttaaccgggttttccggggcgggtacggtcgtacccgtaacggtttccggggacgggtaaacggggaaaccctaaaaaggtacggaaggtaaaccgaaacgggtaaactgggttacggcttaggaacctacaattccgtcgttaccttcgttaactttcccg

SEQ ID NO: 304739 - DNA, 594 bp, Homo sapiens
  misc_feature: GZ8MTXP01AVFA1.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcggtgggtccggccgtggggggtccctggagactctcctgttctgcgtctggtattcattctttagtaaatctggctatcgtcctgggtcccgccaggttccagggccacgggctggatgggtgccagatatacataatgaatgaacaagtaaatatactatggatactcctagaacgggcctattccacctatcctaccagacgaactaattacccaaagaaccattagggtagtaactcgtagacctaaaagtcgaaaccagccctaaggacggaacggcccggaaggaacccgtacggggttagtttttaagttaccggttaagggtaggggaactaaacgttcccgttaaggtcgggaaccgtaacg

SEQ ID NO: 304740 - DNA, 594 bp, Homo sapiens
  misc_feature: GZ8MTXP01B9QMW.10.71.G05.1.454.CMB.2.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctagctcccagacaccaccggagaaattgtgttgacacagtctccagccacgcttgtctttgtctccgaggggaaangccaccctctcctgcagggccagtcagngtgttcgctacttcggttaggggtgtatcaacataaatccggcaggctcccaggctcctcatctttgatgtctttcaacgcgggcccctggccgtcccaggcaggttcaggtggcaggtgggtctggggacagacttcnctctcaccatcagcagcctagacgctagaagtatttgctagtttatactgtcagcagggtcgtgtcctacgtttcgggcggtacggtcgccgtacggtttccgggacgggtaacgggaaacccgtaaaagtacggaaacgggttaaccgaaacggtaaacgtgggttcggttcgttcggaacctaccgtaacgttcgtcgttcctttccgttaactttccccg

SEQ ID NO: 304741 - DNA, 530 bp, Homo sapiens
  misc_feature: GZ8MTXP01EX5H7.10.71.G05.1.454.CMB.2.raw
  modified_base (305)..(305): a, c, t, g, unknown or other
  misc_feature (305)..(305): n is a, c, g, or t
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtgagtcgtgggggagcgtggtccggcgtggggggtccctgagactctcctgttctgcgtctggattcattctttagtaaatctggcatgtcctgggtccncaggttccaggccacgggctggaatggggtgccagatatacataatgaatgaacaagtaaaatatactatggagtactcttagaagggcattacacctagtctaccagacacaattccgaaagaacntgggtatatctgactaaatgaccagcctgagacggccgaaggacgtacggggttntttagttactggtaggaagtaaatccgttaagtggaactaacg

SEQ ID NO: 304742 - DNA, 317 bp, Homo sapiens
  misc_feature: GZ8MTXP01EFCAI.10.71.G05.1.454.CMB.2.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (311)..(317): a, c, t, g, unknown or other
  misc_feature (311)..(317): n is a, c, g, or t
tcagcatagtagtgcacgaccggtgctcgatttagtgtcgtcgcaagagagaggaggggggggctgggaggcctttgttggagaccttgcacttgtactccttgccgttcagccagtcctggtgcacgacggtgaggacgctgaccacacggaacgtgctgttgaactgctcctccgtgtcaccgtctcttcgcctcacaaggccatcgtctcccctggcncctgctcaggancactcgagagcanagcgcctgggctgcctgcaaggctactcccatactatgctgagcggctggcaaaggcgacatagnnnnnnn

SEQ ID NO: 304743 - DNA, 552 bp, Homo sapiens
  misc_feature: GZ8MTXP01BT319.10.71.G05.1.454.CMB.2.raw
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagttttgggctgagcgtggtttcgcgttagctctttaagagatgtcagtgtcagatgcagagtggtggagtcgtgggggagcggtgggtccggccgtggggggtccctgacgctctcctgtctgcgtctggattcattctttaagtaatcgttggctagttcgtccgtcgggtcccgccgacggttccgacgggccgacgggcgtgggaagttggggngccaggtatatanataangaatagaaataagtaaatataatagtaggatactccttacgaacgggtccattaccactactcacaganaacactacaaagaacngtgtnactnananatacacncgcgngacgacgacgacgtacgtaggttagttcgttagtaaggtaggtaacgtacgtacgttagtcgcgtcg

SEQ ID NO: 304744 - DNA, 611 bp, Homo sapiens
  misc_feature: GZ8MTXP01AB2KO.10.71.G05.1.454.CMB.2.raw
  modified_base (257)..(257): a, c, t, g, unknown or other
  misc_feature (257)..(257): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttcngcgtctggattcattctttagtaaatctggcatgtccgtgggtccgccaggttcccaggccacgggctggaagtgggtgcagatataccaatatgatgaacaagtaatatactatggacgtactccgttacaaacggggtcctaattccaacctacttacctaccgaagtaacgaacaattacccgaaagtaacagtaggggttgtaacttccagaaccaaattcgaaccagcccgttgaaggacgcccgaaggaccgttagggggtttattttaaacgttacgtagggttcgggggttaaattaaacgttccgaggtttaacggcagttacccgtaaccgtttgggtttaacg

SEQ ID NO: 304745 - DNA, 568 bp, Homo sapiens
  misc_feature: GZ8MTXP01BK1XH.10.71.G05.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (561)..(561): a, c, t, g, unknown or other
  misc_feature (561)..(561): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacttcgtaggggtgtatcaacataaatccggcaggctccaggctcctnatctttgatgtctttcaacgtacggggccccctgggccgtccccgaggctaggttcaggtggcaggtgggtatggggacagtaaccttcnctctcacntcagcacgcctagacgctagaagtattttgacttagtttattacgtgtcagccagggtcgtcgccctacggtttcgggccgggtaggttcgacctacggtttcgggacgggaacgggaaccaaaagtagagggtaccaaaggtacgtgcggcttgcacgtaatctgttccttcncgttccg

SEQ ID NO: 304746 - DNA, 615 bp, Homo sapiens
  misc_feature: GZ8MTXP01CFI31.10.71.G05.1.454.CMB.2.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttaggggtgtatcaacataaatccggcaggctcccagctctcatcttgatgtctttcaacgcggcccctggccgtcccaggcaggttcaggtgcagtgggtctggggacngtaaccttcaactctacacctatcacgcacgccctagacgcctaggaagttattttgacttagtttattactgtcagctagggcgtacgcctacgtttcgggcggtacggtcgtccgtacgtttccgggacgggtaacgggaaaccgaaaagttacggaacgggtaaccttaaaacgggtaaccgttgggttacggccgttacggaacctaaccccgtaattccgttcggttacctttaaccgttaacgttttcccccg

SEQ ID NO: 304747 - DNA, 590 bp, Homo sapiens
  misc_feature: GZ8MTXP01BXGT1.10.71.G05.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (471)..(471): a, c, t, g, unknown or other
  misc_feature (471)..(471): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcgtggtttcctcgtagctctttaagagatgtcagtgtcagatgcagatggtggagtgtgggggaggcgtggtccggcgtggggggtccctgagctctctgtctgcgtctggattcattacttaagtaaatctggctagtcgttccgtcgggtcccnccgtacggttccacgggcccgacggggcgtagggaagtggggtggcaaggtactaatanaaattanagaattagaataaagtaaaatactagtatgggaactacctaccttagaacgggtctattccaactatacctaccagaactacaacgttaccaaagaacngttaggtatacgttcagacaaacacgactacgacgacgagaacgacggacggtacggttacggttagttagttagttggttaggtaagtacgtaacgtgtagttacgtaacgttcgtcg

SEQ ID NO: 304748 - DNA, 567 bp, Homo sapiens
  misc_feature: GZ8MTXP01BDLW2.10.71.G05.1.454.CMB.2.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgcacttcgttaggggtggtatcaacataaatccggccaggctcccaggctcctcatctttgatgctttcaacagggcccctggcgtcccaggcaggttcagtggcagtgggtctggggacagaacttcaactctcaccatcagcanctagagctagaagtatttagtctagtttaattacttgtctagacacggcgtcgtccgtaccgttcggtcgggacggtacggtcgtacgttccggtacgggtacgggaacggaaacgtaaacgaaaggtaacgaaacgtaaacgtaacgttacggttcgttcgcacaactactcgttcttcttctc

SEQ ID NO: 304749 - DNA, 519 bp, Homo sapiens
  misc_feature: GZ8MTXP01EK6QK.10.71.G05.1.454.CMB.2.raw
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtgggggtcctgagctctctgtctgcgtctggattcatctttagaaatctggcatgtcctgggtccncaggttccaggccagggctggaatgggtggcagatatacaatatgatgaacaagtaaaatntactatgggatactcttagaaagggccattcaccatctaccagagacaattaccaaagaacatggtgtatctgacaaatgaccagcctgagagccgaggaacacgggttgttaattacgtgtagggagaaacttccgtaagtggctatcgacctggttaattcgg

SEQ ID NO: 304750 - DNA, 611 bp, Homo sapiens
  misc_feature: GZ8MTXP01ARL17.10.71.G05.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaangccacctctctgcagggccagtcagagtgttcgctacgtttcggttaggggtgtatcaacataaacgtccggcaggctcccaggctcctnattctttgatgtcctttacaacgtcgggcccctggccgtcccaggctaggttcaggtggcgtaggtggggtcgtggggacaggtaccttcaactctaccacntcgagctagcctagacgcctagtaagtattttgacttaagtttacttacgtgtcgagtcgtacggggtcggtcgtccgtacgtttcgggcggtacggtcgtaccgtacggtttcgggacgggtaacgggaaccgtaaaagtcggaacggtacgaaacgtacgtaggttcggccttacggcacccgtaattccgtacgttccttcgttaacgttcccg

SEQ ID NO: 304751 - DNA, 638 bp, Homo sapiens
  misc_feature: GZ8MTXP01CJJ0I.10.71.G05.1.454.CMB.2.raw
  modified_base (202)..(202): a, c, t, g, unknown or other
  misc_feature (202)..(202): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaangccacctctcctgcagggccagtcagagtgttcgctacttcggttaggggtgtatcaacataaacgtccggcaggctcccgaggctcctcattcttgattgctttcaacgtacgggcccctggccgtcccaggctaggttcaggtggcacggtgggtctgggacagaaccttcnctcgtcacctatcagcacgcctagacnctagaacgttatttgacttagtttattactgtcagcagggtcgtcgtcctacgtttcgggcggtacgggtcgtaccggtaacggtttaccggggacgggtaaccgggaaacccgtaaaaaggtcgggttaaacgggtaaccgttaaaaacggtaaccgtaaggttccgggttacttacgggtaacccaaccgtaactttcccgttaggttccctttaacgttaacctttcccccg

SEQ ID NO: 304752 - DNA, 700 bp, Homo sapiens
  misc_feature: GZ8MTXP01AB6D0.10.71.G05.1.454.CMB.2.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgacgtactctcctgttctgcgtctggattcattcttagtaatctggcatgtcctgggtcccgcctaggttccaggccgacggggtctagggaagtgggggtggacagtaatataacaatatagatgaaaactaaagtaaatataactagtacggaagtactaccttacgaagggtccctaattccaacctataccctaccaaggaactaaacctaaacttacccgaaaaggtaacctaagttggggggttactaaaggtttccctaaggtaaacctaaaagtccggaacccctaaaggccccgttagggaaacggtaccggaccccgggaaaagggtacccgttaaacggggggtttttacgttttaaacggttaacgggttaggggttaaacgggttaaacgttaaaccgttcggtaggtccggtactacgttacccggttaacggtttaaggttaacg

SEQ ID NO: 304753 - DNA, 652 bp, Homo sapiens
  misc_feature: GZ8MTXP01AU5ON.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtccctgagctctcctgttctgcgtctggtattcattctttaagtaatcgtggctagttcgtcccgtcggggtccccgccgtacgggttccgacgggcccgacgggggtcgtagggaagtggggtggccaggtatagtaacaagtaatggaatagaaacaaagttaaaatataactaagtcggaagtacctaccttacgaacggggtcctaattaccacctatcctaccaagacaacctaattaccaaagaactaagttgggtattatccagtaactaaactcgaacccgagcccgaagaacggacggaaccccggaagggtaaccggtaacgggggttttcgtttaacgttacggtaaggggttacgggggtaaataaaaccggttccgttaaggttcgggaacttaaccg

SEQ ID NO: 304754 - DNA, 592 bp, Homo sapiens
  misc_feature: GZ8MTXP01EF0ZJ.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtcctgagctctctgtctgcgtctggattcattctttagtaatctgcagtcgtccgtcgggtcccgccgtacggttccgacgggcccgacggggctagggaagtggggtggccaggataatacaaataatagaatagaaactaaagtaaaactataactagtaggaactacttccttacgaacgggcctaatttaccaactatcctaccaagaacaactaaacttaccgaaaagtaactaagttggtatagtcttagaactaaagtcgaccagcctaaggagacggaccggaggtacgtacgggttgtttacttacgtggtagggtaataaacgtccgttagtcgctaacg

SEQ ID NO: 304755 - DNA, 606 bp, Homo sapiens
  misc_feature: GZ8MTXP01B1ME5.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtgggtccggccgtggggggtccctgagactctcctgttctgcgtctggattcattctttagtaaatctggcatgtccgtggtccgccaggttccagggcccacgggctggaatggggtgccaggatagtaacaataatgaatgaaacaagtaaaaatataactaataggaatactaccgttacgaaacggggtccctaatttaccaacctactcctacccaagaacgaactaaactttacccgaaaagtaaaccgtaattagggtagttaatccgttaggaacaaaattcgaaccaagccctaaggacgagacccggaaggaaccgtacgggttagtttattacgtggtagggaagtaaacgtccgttaggtcggcgtaacg

SEQ ID NO: 304756 - DNA, 539 bp, Homo sapiens
  misc_feature: GZ8MTXP01DL3K9.10.71.G05.1.454.CMB.2.raw
  modified_base (355)..(355): a, c, t, g, unknown or other
  misc_feature (355)..(355): n is a, c, g, or t
  modified_base (464)..(464): a, c, t, g, unknown or other
  misc_feature (464)..(464): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtgagtcgtgggggagcgtggtccggccgtgggggtccctgagactctcctgttctgcgtctggattcatctttagtaaatctggcatgtcctgggtccgccaggttccagggccacgggctggaatgggtgccagatatacaataatgntagaacaagtaaaatatactatgggatactccttagaaggtccattacaccatctccaagacaactaaacttccgaaagaactaatggtatatctgaacaaatgaaccngcctaagacgagtccgaaggtactcggggttagtttnttacgtggtagggtaanaaattccgttagtggctaacg

SEQ ID NO: 304757 - DNA, 593 bp, Homo sapiens
  misc_feature: GZ8MTXP01A3WTF.10.71.G05.1.454.CMB.2.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgctacgttcggttaggggtgtatcaacataaatccggcaggctcccaggctcctcatcttgatgctttcaacncgggcccctggccgtcccagggctaggttcaggtggctaggtcgggtctggggacagtaccttcactctcaccatcagcagcctagcgcctagaagtatttgacttagtttacttacttgtacagtcgagcggtcgtccgtacgttcgggcggtaggtcgtccgtacgtttcgggacggtaacggtaaaccgaaagtaaggaacggttaacgaaacgaacgtcggtacggcgttcggaccctaaccgtacttcgttacgtccttacgtaacgtttcccgttaaccccg

SEQ ID NO: 304758 - DNA, 732 bp, Homo sapiens
  misc_feature: GZ8MTXP01EXU63.10.71.G05.1.454.CMB.2.raw
tcagcatagtagtgcacgaccggtgctcgatttagtgtcgtcgcaagagagaggggggagctctgggagaggagcccagcactagaagtcggcggtgcctccattcggtgatcagcactgaacacagaggactcaccatggagtttgggctgagcttgggtttttcctcgttgcttcttttaagagtatgtccagtgtcagatgcagatggtggagtcgtgggggagcgtggtccggcgtgggggtccctgacgctctcctgttctgcgtctggattcattcgtttaagtaaatcgtggctagttcgtccgtcggggtccccgcgtacgggttcccgaacgggcccgaacgggggctagggaagtgggggtgaccaaggtataatacaaattaatgaattagaaactaaagttaaaattataacgtagttagggaactaccttccgttacgaaacggggtcctaatttacccaaccctaattcccgtaaccaaggaactaaacctaaactttaccccggaaaagtaaaccggtaagtttcggggttaagttaaactccgttaaaggaaccgtaaaaacgtaaccgtaaccgtaaccgtaccgtaacggtaacggaaccgggtaaccgggttaaacgggtaaaccgggttaacgggtttaacggttttaacggtttaacggttaagggtaagggtaacggtaaacgtacgttacggtaacggttaacgtaacg

SEQ ID NO: 304759 - DNA, 591 bp, Homo sapiens
  misc_feature: GZ8MTXP01EIF2Z.10.71.G05.1.454.CMB.2.raw
  modified_base (316)..(316): a, c, t, g, unknown or other
  misc_feature (316)..(316): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (545)..(545): a, c, t, g, unknown or other
  misc_feature (545)..(545): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggaggcgtgggtccggcgtggggggtccctgagactctcctgttctgcgtctggattcattctttaagtaaatctggcagtcgtccgtgggtccnccgtaggttccagggccaggggctggaagtgggtggccagatatanaataangaatgaaactaagtaaaatataactagtaganactccttacgaacgggccaattccaactactctaccagaagaactaaacttaccgaaagtaaactagtagggttatagtccttagaaccaaaagtcgaacccagtccctaagggacgacggcccggaaggacccgtagggggttntttagttacgtggtaggggaataaacgtcttaggttcgaactaacg

SEQ ID NO: 304760 - DNA, 656 bp, Homo sapiens
  misc_feature: GZ8MTXP01C8MMM.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcggtggtccggccgtgggggtccctgagactctcctgttctgcgtctggtattctattctttaagtaaatctggctagttcgtccgtcgggtccccgtccgtacgggttcccgacgggcccgacgggggtcttagggaagttggggtggacccaggtataagtaacaaataatgaatagaaactaaaggttaaaaatataacgtagtacggacgtactaccgttacgaacgggtcctaattaccaacctactacctaccaagaacgaactaaacttaacccaaagtaaacgtagttaggtagtaactcgttagaactaaatcgaaaccacgccgtaaggaacgacggcccgaaagggtaaccgtacggggtttacgtttagttacgttaagggtaacgggtaagtaaacgttccgttagtcggttctaacg

SEQ ID NO: 304761 - DNA, 564 bp, Homo sapiens
  misc_feature: GZ8MTXP01AQRN3.10.71.G05.1.454.CMB.2.raw
  modified_base (268)..(268): a, c, t, g, unknown or other
  misc_feature (268)..(268): n is a, c, g, or t
tcagcatagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtanctgcaaatgaccagcctgagagccgaggacgacggggttgtttattacgtgtgggagtaaatcctaggtggcatcccaccttggtattgtgtaacgttccggggcagggaccgtggtcacgtctcttcgcctccaccgacggccactcggtcctccccgtgccgccctcgctccgaggacggcacccgtccgagacgccacgacggccggcccgtgggcctcgccgtcggtcgaacggccttaccttcccctacttaccttattcgcctggaacgcggggcgttcggcgaaggccg

SEQ ID NO: 304762 - DNA, 601 bp, Homo sapiens
  misc_feature: GZ8MTXP01AKEFW.10.71.G05.1.454.CMB.2.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcgttaggggtgtatcaacataaatccggcaggctcccaggctcctcatctttgatgtctttcaacgacggcccctgggccgtcccaggcaggttcaggtggcaggtggtctggggacagacttcnctcncacntcagcacgcctagacgctagaagtatttgcttagtttatactgtacagcacggtcgtgtcctacgtttcggcggtaggtcgtacccgtacgtttcggggacggtaacgggtaacccaaaagttcggaacgggttaaccgaaaacggtaaaccggttggttacgggttccttacgggtcccaaccggtaacttccgttcgttaccctttccgttaactttcccccg

SEQ ID NO: 304763 - DNA, 610 bp, Homo sapiens
  misc_feature: GZ8MTXP01AZ0YH.10.71.G05.1.454.CMB.2.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgcagggccagtcagagtgttcgctacgttcgttagggtgtatcaacataatccggcagctcccagctcctnatctttgatgtctttacaacgacgggcccctggccgtcccaggctaggttcaggtcggctacggtggggtctaggggacagtaacttcaactctaccaccatcgagcacgcctagacgcctagaacgttatttagactagtttactacttgtacagcaggtcgtcgtcctacgtttcggcggtaggtcgacccgtacgttccgggacggtaacgggaaacctaaaaggtacgaacgggttaacaaacggtaaacgttggaggttccgttacgtaaccgaaccctaagttccgttacgttaccttcttaacgtttccccg

SEQ ID NO: 304764 - DNA, 562 bp, Homo sapiens
  misc_feature: GZ8MTXP01DJWGN.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggcccagtcagagtgttcgctacttcgttaggggtggtaatcaaacataaatccggcaggctcccaggctcctcatctttgatgctttcaacacggggcccctggccgtcccaggccaggttcaggtgcaggtgggtactggggacagaacttcaactctcaccatccagcacgcctagagcctgaagtatttagctagtttattactgtcagccaggcgtgcctacgtttcgggcgaggtgcccgtacgtttcgggacggtacggggaaccaaaagttaggaaggtacgaaaacgtaacgtggttaggttcttagcacctaatctgttcttcaacgttccc

SEQ ID NO: 304765 - DNA, 618 bp, Homo sapiens
  misc_feature: GZ8MTXP01BSW87.10.71.G05.1.454.CMB.2.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (355)..(355): a, c, t, g, unknown or other
  misc_feature (355)..(355): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtgggggtccngagctctcctgttcngcgtctggattcattcttagtaaatctggcatgtcctgggtccgcctaggttcccaggccacggggctaggaagtgggtgacagactataaccgaatangatgaaactaaagtaaatagtaactagtaggaactacttcttacgaaggggtaccctaattaccacctactctacccgaagtactaacaattacccaaagaactagttaggggtagttatcctagactaaaagtcgaaacccgtagtacccgtggaaacggacggcccggaaagggtaccgttagggggtttattttaacgtacggttggttaggggaattaaacgttcgtaagtggacctagttcctaacgttgggtttaag

SEQ ID NO: 304766 - DNA, 628 bp, Homo sapiens
  misc_feature: GZ8MTXP01E0I40.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcgtggtccggcggtgggggtcctgagctctcctgttctgcgtctggtacttctattactttagtaaattcgtggctagttcgtcccgtcggggtcccgccgtacgggtttcccgacgggcccgacggggtctagggaagtgggggtcggacccaggtactaataacaagtaatagaattaggaaactaaagttaaaatataacgtagtgggaactacttccgttacgaacgggcctacttaccacctatcctaccgagaacgaactaaacttaccgaaagaaactagttagggttatataccgttagaacctaaatcgaaccagccgtaaggacgacggaccgaggacgtaacgggttgtttaagttacgtgagggaataaacgtcgttagtggttaactaacg

SEQ ID NO: 304767 - DNA, 599 bp, Homo sapiens
  misc_feature: GZ8MTXP01D2R9Z.10.71.G05.1.454.CMB.2.raw
  modified_base (313)..(313): a, c, t, g, unknown or other
  misc_feature (313)..(313): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgttgggttttcctcgttgcttcttttaagagtatgtccagtgtcagatgcagatggtggagtcgtgggggagcggtggtccggccgtgggggtccctgacgactctcctgttctgcgtctggattcaattctttagtaaatctgcatcgtctgggtccncaggttccaggccacgggctggaatgggtgccagatatacaataatgaatgaacaaagtaaaatataactataggacgtacttccttacgaagggtcctaatttaccaaccctattcctaccaagaacgtaaacaaactttacccgaaaagtaactaagtggttagtacttcctaggaaccaaagtcgaaccagccctaagacgacggaccggaggtaaccgtacgggggttattttattaccgtgggtaagggtaacgtaaactccgttaggttcggcttaaccg

SEQ ID NO: 304768 - DNA, 660 bp, Homo sapiens
  misc_feature: GZ8MTXP01AW9HL.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcgtgggggaggcgtgggtccggcgtggggggtccctggagactctcctgttctgcgtctggattcattctttaagtaaatcgtggcatgtcctgggtccgccaggttccagggccacgggctggaagtggggtgccaggatatacaataatgaatgaacaagtaaaatataactagtggagtactccttacgaacgggtccgattaccacctaatccgtaccaagaacgtaaccaaacttacccaaaggtaaacctaagttaggggttattaagtaccctaggaaccctaaaattacggaacccaacgggcccctaagggaacggaacgggacccgggaacggggtaaacccggtaacgggggtttacgttttaacggttaaccggttaagggttagggggtaacgtaaaaacgtccccggttaaagggtcgggttaactaaccg

SEQ ID NO: 304769 - DNA, 736 bp, Homo sapiens
  misc_feature: GZ8MTXP01D1B7P.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagtcgttgggttttcctcgttgcttcttttaagagatgtccagtgtcagatgcagagtggtggagtcgtgggggaggcggtcggtccggcgtgggggtcctgacgctctcctgttctgcgtctggtattctattctttaagtaaatcgtggctagttcgtccgtggggtccccgccgtacgggttccgacggccgacgggggtcgttagggaagtggggtcggaccgtaaggtaataataaacgaaattaaagtagtaagtagtaaacctaaagttaaaaatataaacgttagtacgggtaacgtaccttaccgttaacggaaacggggtacctaacgtttacccaaccctattacctacccgaaagtaaccgtaaacgtaaaccttaaccggggaaaataaaccgtagttacgggttaattaacgtcccggttaaacgaaacgtaaacgtaccgaaccgtacggacgtaagggaacggaccgggtaaccgggttaaacgggtaacggttaacgggtttaagtttaacgttagggtaaggggtaacggtaaacgttaacgtacggttacgtaacggttaactaacg

SEQ ID NO: 304770 - DNA, 537 bp, Homo sapiens
  misc_feature: GZ8MTXP01EBD08.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttagggtgtatcaacataaatccggcaggctccaggctctcatcttgatgctttcacaggcccctggctcccaggcaggttcagtggctagtgggtctggggacagaaccttcaacgtctcaccatcagcacgcctagacgctagaagtatttagctagtttatactgtcagcaggcgtgcctacgtttcggcggtaggtcgcctacgtttcggcggtacgggaaccaaaagttagaggtacgaaacgtacgtgttacggcttacgctacaagtctgttcttcgcttcccg

SEQ ID NO: 304771 - DNA, 557 bp, Homo sapiens
  misc_feature: GZ8MTXP01C9WAY.10.71.G05.1.454.CMB.2.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctctcctgcagggccagtcagagtgttcgctacttcgttagggtgtatcaacataaatccggcaggctccaggctcctcatctttgatgctttcaacagggccccctggctccccaggcaggttcagtggcagtgggtctgggacagaacttcnctctcaccatcagcagcctagagcctagaatatttgctagttttatactgtcagcaggtcgtgcctacgtttcggcggtaggtcgccgtacgtttccgggacggacgggaacctaaaagtaggaacgggtaccaaacggtaaacgtggttcggcttcggaaccacctaattctagttccttcgaacgtttccccg

SEQ ID NO: 304772 - DNA, 845 bp, Homo sapiens
  misc_feature: GZ8MTXP01D1GJU.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagatggtggagtcgtgggggagcggtggtccggccgtgggggtccctgacgtactctcctgttctgcgtctggattcattactttaagtaaatcgttggctagtcgtccgtggggtcccgacctacgggttcccagggcccgacgggggtcttagggaaagtgggggtacggcctaaggattaataaccaaagttaaagttagaacgtaggtaaacctaaaaggtttaaaaaaattacgtaacgttaaaggttagggtaaacggttaaccctttaccccgtttaacgggaaaaccgggggtacccgttaaaacttttaaccccgaaaccccgttaacgtttacccctaaccccgtaaaagggaaaccgtaaaaaccctaaaaacctttttaacccccgggaaaaaaggggtaaaccctaaaggtttacgggggtaagtttaaccttaccgtttaaaggtaaaacccaaaagttacccgggaaaccctaacggtccccgtaaagggaacgggaacccggtaccccggggaaaagggtaaaccccggttaacgggggttttacgttttaaacgttaacgggttaagggtaacggggtaaagttaaaacgtcccggttaacgtaaggggttaacccgtttaacggg

SEQ ID NO: 304773 - DNA, 608 bp, Homo sapiens
  misc_feature: GZ8MTXP01A0UOV.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcggtgggtccggccgtggggggtccctgacgctctcctgttctgcgtctggtattcattctttaagtaaatctggcagtcgtccgtgggtcccgcctagggttccacgggccgacggggctgggaagtggggtggccagtatagtacaataatgaatagaaactaaagtaaaatataactagtggactacttaccgttacgaacgggcctaattaccaacctatcctaccaagaacgaactaaacttaccgaaagtaactagtggtagtactctagaactaaagtcgaaccgacgcctaaggaacggttacggaccgagggtaccgtacggggtttagttacttaggtggtaggaataaacgtcgttaaggtcgaacgtaacg

SEQ ID NO: 304774 - DNA, 619 bp, Homo sapiens
  misc_feature: GZ8MTXP01BTUJN.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaancgcccaccctctcctacgagggccagtcagagtgttcgctacttcgttagggtgtatcaacataaatccggccaggctcccagctcctcatctttgatgtctttcaacgcgggcccctggccgtcccgagggctagggttcaggtcggcgtaggtcgggtcgtgggacagtacttcactcgcacccatcagcagccctagacgtccgtgtaagtatttgacttagtttattacgtgtcagtcagtcggtcgtccgttacgtttcgggacggtaggtccgtccgtaccggtttcgggcgggtaaacggtaaccgtaaaaggtaacggtaacggttacgaaacgttaaccggtggtagccgttcgacctaaccgtacgttccgttcgttcctttacgtaaccgtttcccgttaaccccg

SEQ ID NO: 304775 - DNA, 635 bp, Homo sapiens
  misc_feature: GZ8MTXP01ESI10.10.71.G05.1.454.CMB.2.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgctgtctttgctccgaggggaaancgccaccctctcctgcagggccagtcagagtgttcgctactttcggttaggggtgtatacaaacataaatcccggaccaggcctcccaggtcctcctcattctttgattgtctttacaacgtacggccccctggccgtcccgaaggctaggttcagtgcgtaggtgggtctgggacagtaccttcaactctaccaccgatccaggtcacgtcctagacgaccgtagaagttattttagacttagtttattacgtgtacagtcacggggcgttcgtcctacgttccgggcggtaggtcgtacccgtacggttcgggacgggtaacgggaaaccctaaaaagtcggttaaacggtacaaaaacgggtacgtcggttggccgttacggaaccctaacctaacgttccgtcgttacctttaacaactttccccgg

SEQ ID NO: 304776 - DNA, 536 bp, Homo sapiens
  misc_feature: GZ8MTXP01A73QC.10.71.G05.1.454.CMB.2.raw
  modified_base (364)..(364): a, c, t, g, unknown or other
  misc_feature (364)..(364): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcggtggtccggcgtgggggtccctgagctctcctgttctgcgtctggattcattctttagtaaatctggcatgtcctgggtccgccaggttccaggccgacgggctggaagtggggtgccagatatacaataatgaatanaacaagtaaaatataactatggatactcttacgaagggccgattccactatctaccagaagactaaattccgaaagaactatggtagtatctnacaaatcgaccngcctgacgngaccgaggacgtacgggttgttattacgtggtagggaataagtccttagtggctaacg

SEQ ID NO: 304777 - DNA, 592 bp, Homo sapiens
  misc_feature: GZ8MTXP01EZSFT.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgacgctctctgttctgcgtctggattcattctttagtaatctggctatcgtccgtcgggtccgccgtacggttccgacgggccgacgggcgtggaagtggggtggccaggatatacaataatgaatagaacaagtaaatataactatagggatactccttacgaacgggtccatttacccactaatcctaccagtaacgaactaacttaccgaaagaactagttggtacgtatcgtagaacctaaagtcgaacccgagccgtaaggacgacggccggttaaggaccgtaacggggttgtttaagttacgtggtagggtaacgtaaacgtccgttaggtcgctaacg

SEQ ID NO: 304778 - DNA, 741 bp, Homo sapiens
  misc_feature: GZ8MTXP01BGDAZ.10.71.G05.1.454.CMB.2.raw
  modified_base (253)..(253): a, c, t, g, unknown or other
  misc_feature (253)..(253): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtcctgagctctctgttcngcgtctggattcattctttagtaaatctggcagttcgtccgtcgggtcccgccgtaggttcccacgggcccgacggggctagggaagtggggtgcagatataaccaatatgatagaaactaagtaaatataactagtaggaacgtaccttcccgtttacgaaacggggtccctaatttacccaacctacttcccgtaccccgaaaggtaacgtaacctaaacttaccccaaaaggtaaaccttaagttaggggggttacttaacgttcctaacggtaaactaaaacgttaccggaaacccgtaacggtaccccgttaggggaaaccggtaccgggtaccccggggaaacggggtaacccgttaaccggggggtttttagtttttaaaccggtttaaccggttaggggttaaggggttaaacgttaaaacgttcccggttaagggtcggtacctaacgttaccgttaacccgtttggggttttaaccgg

SEQ ID NO: 304779 - DNA, 600 bp, Homo sapiens
  misc_feature: GZ8MTXP01AXPFZ.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtcctgagctctcctgtctgcgtctggattcatctttagtaatctggcatcgtccgtgggtcccgcgtacggttccaggcccgacggggtctgggaagtgggggtggctaagatatacaatatagatgaacaaagttaaataatactatggatactcttacgaacgggcctattaccacatctacaagacgacaacttaccaaagaacagttgggtagttataccgttagaactaaagtcgacccgaagtccctaggaagacggacccggaaggaaccgtacgggggtttatttaacgttgtaggtagggaaacttaacgttccgtaaggtcgaacgtactccgttaccgttggttaaccgttaaggg

SEQ ID NO: 304780 - DNA, 668 bp, Homo sapiens
  misc_feature: GZ8MTXP01B6BDQ.10.71.G05.1.454.CMB.2.raw
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtccctgacgtctctcctgttcngcgtctggtattcattctttaagtaatcgtggctagtcgtccgtgggtcccgccgtaggttcccaggcccgacgggctagggagtgggtgcagatatacaatntagatagaaacaagttaaatagtactagtacggacgtactccgttacgaacgggtcctaacttcaaccctatactacccaagacgtaacctaaacttaccaaacgtaactacgttagggggttagttaaactccgtagtaactaaaacgttcggaaccaacggtccctagggaacgacgggtccccggaaagggtacccggttaacggggttttagtttttaacgttaacggttggggttaagggttaaacgttaaacgttcccgtaggtcggtaccgtacttaccgtaaccggtttaagtttaagg

SEQ ID NO: 304781 - DNA, 591 bp, Homo sapiens
  misc_feature: GZ8MTXP01BE9DH.10.71.G05.1.454.CMB.2.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacgttcggttagggtgtatcaacataaatccggcaggctcccaggctcctcatctttgatgtctttcaacgcgggcccctgggccgtcccgaggcgtaggttcaggtggcaggtgggtatggggacagtacttcnctctcacatcagcacgcctagagcctagtaatattttagcttagtttatactgtcagcagggcgttgcccgttagttcgggcggtcggtcgacccgtacggttcgggacggtaaggggtaaaccaaaaggtcggaaacgggtaacaaaacggtacgtcggttacggttcttcggtaaccaccgtaattccgtagttccttccttaacgttccccg

SEQ ID NO: 304782 - DNA, 586 bp, Homo sapiens
  misc_feature: GZ8MTXP01A7OWT.10.71.G05.1.454.CMB.2.raw
  modified_base (503)..(503): a, c, t, g, unknown or other
  misc_feature (503)..(503): n is a, c, g, or t
  modified_base (553)..(553): a, c, t, g, unknown or other
  misc_feature (553)..(553): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcgtggtccggccgtggggggtccctggagctcgtcctgttctgcgtctggattcattctttaagtaaatctggcatcgtccgtgggtcccgcgaggttccagggccacgggctggatggggtgccagatataacataatgaatagaactaagtaaaatataactagtaggaacgtacttccgttacgaacgggccgtaattaccacctatcctaccgaagaacgaactaacttacccgaaagaactatgggttatactcgtagaacaaagtcgaaccngccgtaagacgacggccgaaggtaccgacggggttcttcgagtttaacgnggtaaggggaataagttccgtaagttcggtaac

SEQ ID NO: 304783 - DNA, 522 bp, Homo sapiens
  misc_feature: GZ8MTXP01BZY0J.10.71.G05.1.454.CMB.2.raw
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcgtggtccggccgtggggggtccctgagactctcctgttctgcgtctggattcatctttagaaatctggcatgtcctgggtccncaggttccaggcccacgggctggaagtgggtggcagatataanaatatanatanaanaaaataaataatatagtagagtactactacgacggactactacacactctacagagaacaactacaacgaanatagtaggtatatanacaanacgacacgacngagagcgagaacgtaggttagttattagtgtaggagattactaagtgcactcttacgtgttgtg

SEQ ID NO: 304784 - DNA, 624 bp, Homo sapiens
  misc_feature: GZ8MTXP01E0YTM.10.71.G05.1.454.CMB.2.raw
  modified_base (454)..(454): a, c, t, g, unknown or other
  misc_feature (454)..(454): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtggttttcctcgttgctctttaagagatgtccagtgtcagatgcagatggtggagtcgtgggggagcgtggtccggcgtgggggtccctgagactctcctgttctgcgtctggtattcattctttagtaatctaggctattcgtccgtgggtcccgcgtacgggttccgacgggcccgacgggggtctagggaagtgggggtgccaaggtatataacaaattaatgaatagaaactaaagttaaaatataacgtagtaggactactccttagaacgggccattaccactatcaccagaanactaactaccgaaagtaaacagtggttagtaactcgtagaactaaacgtcgaacccgacggaccctaagggaacgaccgggaccgggaaacgggttaccgaacggggttttagttttacgttacggttggtaacggggtaataaacgtccgttaggttcggaacttaacg

SEQ ID NO: 304785 - DNA, 729 bp, Homo sapiens
  misc_feature: GZ8MTXP01ELCJP.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcggtggtccggcgtgggggtccctgagctctcctgttctgcgtctggtattcattcgtttaagtaaatcgtggctagtcgtccgtcggggtccccgaccgtacggtttcccgacgggtcccgacgggggtcttagggaaacgttgggggtaggcccaaggtaactaagtaacctaaataatagaagtagaaactaaaggttaaaaatacgtaaacgtagtacgggaactaccgttacccgttacgaaacggggtacctaactttacccaacctaactccctaaccaaagaacgtaaacctaaacgttaccgaaaacgtaaataagttacgggtataactcgtacgaaactaaaacggtcaaaccgacgccgtaaggaaacgacgggaaccccggaagggtaaacccggttaacggggttttagtttacgtttaaaccgggtaagggttaaggggtaaaacgttaaaacggttcccgttaaagggttcggttaaccccgttaacg

SEQ ID NO: 304786 - DNA, 591 bp, Homo sapiens
  misc_feature: GZ8MTXP01DD9PV.10.71.G05.1.454.CMB.2.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgcttgtctttgctccgaggggaanagccacctctctgcagggccagtcagagtgttcgctacttggttagggtgtatcaacataaatccggcaggctccaggctctcatcttgatgctttcaacnggccctggcgtcccaggcaggttcggngcagtcgggctgggacagcttcatctcaccatcagcagcctagagcctagacgtatttggactagtttattactgtcagcagcggtcgtcctacgtttcgggacggtacggtcgaccgtacgtttccgggacgggtaacggggaaccctaaaaagtgggaaacgggttaaccgaaaacggttaaaccgttgggtacggttaccgttggaccaacccggtagttccttcggttacctttcgtaaccgttccctttcccccg

SEQ ID NO: 304787 - DNA, 535 bp, Homo sapiens
  misc_feature: GZ8MTXP01DX9KY.10.71.G05.1.454.CMB.2.raw
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtccctgagctctcctgttctgcgtctggattcattctttagtaaatctggcatgtccgtgggtccgccaggttccagggcccgacgggctgggaagtggggtgccagatagtacaataangaatgaactaagtaaaatatactatggatactcttacgaagggcatcacatctcagtanactaattacaaanactatgtagtatctgactaatcgacagcctgagttacgacgaggtacgtacgggttgttagttacgtgggtaggaacgtaatccgttaggtcgaactaacg

SEQ ID NO: 304788 - DNA, 550 bp, Homo sapiens
  misc_feature: GZ8MTXP01B2S6O.10.71.G05.1.454.CMB.2.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtgtatcaacataaatccggcaggctcccaggctcctcatctttgatgctttcaacncgggcccctggccgtcccaggcaggttcagtggcnggtgggtctggggacagaaccttcnctctcacccatcagcagcctagacgcctagaagtnttttagactagtttattactgtctagcaggtcgtcgccgtacgtttcgggcggaggttcgccgtccgtttcgggacggtacgggaaccaaaagtggaggtacaaacgaacgtggnggcttgtcactcgtctgttcttcttcttcccg

SEQ ID NO: 304789 - DNA, 725 bp, Homo sapiens
  misc_feature: GZ8MTXP01AGDBR.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggccgtggggggtccctgagactctcctgttctgcgtctggattcattctttagtaaatcgtggctatcgtccgtcggggtccccgccgtacgggttcccgacgggcccgacgggggtcgtagggaagtgggggtcggaccaggtataagtaacaataagtagaatacgaaactaaagttaaaaactataacgtaagtacgggaacgtaccttacccgttacggaacggggtaccctaatttacccaacctactaccgtacccgaagtaaacgtaacctaaaccgtttaacccggaaaacgtaaaccgtaaggtttacgggttaagttaactacgttaaggaacctaaaacgttccgaaacccgtaggccccgtaagggaacggaaccgggtaccgggaacgggtaaaccggttaacgggggtttagttttaacgttaccggtaaggggtaggggtaacgtaaaacgttccgttagggtcgggaaccttaaccg

SEQ ID NO: 304790 - DNA, 695 bp, Homo sapiens
  misc_feature: GZ8MTXP01EZ3YI.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtcctgagctctcctgttctgcgtctggattctatctttagtaaatctggctatcggtccgtcggggtcccgccgtacggttcccgacgggcccgaacgggggtcgtaggggaagttgggggtacggacgaagaattaataactaaattatgaatagaactaaaaagttaaaataattaactaagtagggaacgtaccttaccgttacgaaacgggtcccgtaattacccaacctacttcctacccgaaagaacgtaaacctaaacgttaccaaaagtaaacctagttagggttacgttaacttacgtacggaacaaaacgttcgaaacccaggtaccgtagacgacggaccggaagggtaacgtacggggtttagtttaacgttacggtaggtaagggaacgttaaacgttccgtaaggtcggtaactaacgttaccgttaccgttgggtttaacgtttcggg

SEQ ID NO: 304791 - DNA, 565 bp, Homo sapiens
  misc_feature: GZ8MTXP01A49LO.10.71.G05.1.454.CMB.2.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgagggaaanagccaccctctcctgcagggccagtcagagtgttcgctacttcggttagggtgtatcaacataaatccggaccaggctcccaggcctcctcatctttgatgctttcaacncgggcccctggcctcccaggcaggttcaggtgcagtgggctgggacngaacttcnctctcaccatcagcagcctagacgcctagaagttattttagcttagtttattactgtcagtcagggtcgtcgcctacgtttcgggcggtaggttcgaccgtacgttcggggaccggtaagggaacccaaaagtggacggtacaaacggactggttcggcttgccgtaccaattccgtgttaccttcgaacgtttccc

SEQ ID NO: 304792 - DNA, 680 bp, Homo sapiens
  misc_feature: GZ8MTXP01ATGIR.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggaaancgccaccctctcctgcagggccagtcagagtgttcgctacttcggttagggtgtatcaacataaatccggcaggctccagctcctcatctttgatgctttcaacgacggccctggcgtcccaggctaggttcaggtgcgaggtgggtcgtgggacagtaacttcaactcgtacaccatcacgctacgccctagacgccgtagaacgttgttttaggacttaaggttttacttacgttgttacaaggtccgtaaggggtcggttacgtcccgtaacggttttcgggccgggtaaggttcggtacccgttaaccggttttccgggggacggggtaaacggggtaaacccgtaaaaagttaacgggttaaacggggttaaccgaaaaaccgggtaaccgttagggttccgggttacgttaccgggcccttaaaacccgtgttcccgttcgggtttacctttaaccgttaacctttcccccg

SEQ ID NO: 304793 - DNA, 574 bp, Homo sapiens
  misc_feature: GZ8MTXP01CL145.10.71.G05.1.454.CMB.2.raw
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcgtgggggagcggtggtccggcgtggggggtccctggagactctcctgttctgcgtctggattcattctttagtaaatctggcatgtcctgggtccncgaggttccaggcccgacgggtctggaagtgggtggaccagatactanaataatgaatagaacaaagtaaaatataactaataggacgtacctccttacgacggggacctattacaaccattccaccagaacgaactaattacccgaaagaactattggtatatcctgaacaaactgaaccagcctaagaagacgccgaggaaaccgtgggttagtttattacgtggtagggtaagtaaaagtccgttaggtcgcgtaaccg

SEQ ID NO: 304794 - DNA, 795 bp, Homo sapiens
  misc_feature: GZ8MTXP01DVOAH.10.71.G05.1.454.CMB.2.raw
  modified_base (261)..(261): a, c, t, g, unknown or other
  misc_feature (261)..(261): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgcttcttttaagagatgtccagtgtcagatgcagagtggtggagtcgtgggggagcggtggtccggcgtgggggtccctgagactctcctgttcngcgtctggattcattctttaagtaatcgtggctagtcggtccgtcgggtccgcccgtacggttccgacgggtcccgacggggtctaggggaagtgggggtcgcagtatataactaatatagaaatacgaataaagtaaaattacgttaactagtacgggaactacccgttaccgttacgaaacggggtcctaacttccaacctactcctaaccaaggaactaaacctaaacgtttaacccaaacggtaaactaaggtttaggggttaacttaacgtaccgtaacggtaaaccctaaaacggttacccggaaaccccgttaacgggaccccgttaaggggaaaccgggaaaccggggtaccccggggttaaaaggggttaaaccccgggtttaaacgggggttttaaggttttttaaaccggttaaaccggggtttcgggggttaaaacggggggttaaaataaaaacccgtttcccgggttttaaaggggaccggggttaacccttaacgttaacccggttttaaacccggggg

SEQ ID NO: 304795 - DNA, 615 bp, Homo sapiens
  misc_feature: GZ8MTXP01BZZES.10.71.G05.1.454.CMB.2.raw
  modified_base (261)..(261): a, c, t, g, unknown or other
  misc_feature (261)..(261): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttcngcgtctggtattcattctttagtaatctggcatcgtcctgggtcccgccagggttccagggccacgggctgggaatggggtgccaggatanacaataatgntgaactaagtaaaatatactagtggacgtacttaccttacgaaagggccaattaccacctatcctaccagagacctaaattacccgaaagtaacctagtcgggttataactccgttagaacctaaattccggaaaccctaggccctaagggaaggacggaccccgggaaagggtaccgtaacgggggtttacgtttagtttaccggtaagggttagggggtaaataacgttccgttaggttcggaacttaacg

SEQ ID NO: 304796 - DNA, 564 bp, Homo sapiens
  misc_feature: GZ8MTXP01DEEM7.10.71.G05.1.454.CMB.2.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgtggtttcctcgttgctctttaagagatgtccagtgtcagatgcagatggtggagtcgtgggggagcgtggtccggcgtgggggtcctgagctctcctgtctgcgtctggatcatctttagtaatctggctatcgtccgtgggtcccnccgtacggttccaggccgacgggctggaagtgggtggcagaatataacaatatagatgaataaaagtaaaattntactaataggacgtactcttacgaaacgggccctattcacctatcctacaaggtacaactaaacttaccaaagaacatagtaggtatatataatacgacacgccagagagacgacgacgtaaggtagttattagttagtaggtaagttaagttaccgttagttggataactactaccgttagtaagttgttaaccggg

SEQ ID NO: 304797 - DNA, 664 bp, Homo sapiens
  misc_feature: GZ8MTXP01EFNRV.10.71.G05.1.454.CMB.2.raw
  modified_base (658)..(658): a, c, t, g, unknown or other
  misc_feature (658)..(658): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagtcgttgggtttttcctcgttgtcttacttttaagagtatgtccagtgtcagatgcagagtggtggagtcgtgggggagcggtgggtccggccggtcgggggtcctggacgtactctccgtgttctgcgtcgtggatttcattctttaagtaaatctggcagtcgtccgtgggtcccgcacggtttccacgggtccacggggctggaagtggggtgaccaggtaaatacgtaacaagttaatgtaactagaaactaaagttaaaaactataactaagtacgggtaacgtaccttacccgtttacggaaacggggtcctaaactttaccaaccttaacgttccctacccgaagaacgaaacctaaacgttaaccgaaacgtaaactaagttagggtagtataccgtgaaacctaaagtcgaaccgagtccctaaggacgacggacccggaaggtaccgtaacgggttgtttacttacggtggtaagaagtaactccgttaaggtcggntaaccg

SEQ ID NO: 304798 - DNA, 552 bp, Homo sapiens
  misc_feature: GZ8MTXP01AOQ11.10.71.G05.1.454.CMB.2.raw
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtgagtcgtgggggagcgtggtccggcgtgggggtccctgagactctcctgttctgcgtctggattcatctttagtaatctggcatgtccgtgggtcccgccgtacggttccgagggcccgacggggtctaggagtggggtgccaggtatatacataatgntagacaagtaaatntactatgacgctctcgaacgggcattcacntccncaganacaatccgaaagactagtggtagtatcgtagactaaagtcgaccaagcccgtaagacggacgccggaggtaacgtacgggttagtttagttacgtaaggtaggggtaataacgttccgttaggtcggctaacg

SEQ ID NO: 304799 - DNA, 642 bp, Homo sapiens
  misc_feature: GZ8MTXP01ACLEA.10.71.G05.1.454.CMB.2.raw
  modified_base (200)..(200): a, c, t, g, unknown or other
  misc_feature (200)..(200): n is a, c, g, or t
  modified_base (352)..(352): a, c, t, g, unknown or other
  misc_feature (352)..(352): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccagctgtctttgctccgaggggaangccacctctctgcagggccagtcagagtgttcgctacttcggttagggtgtatcaacataaactccggcaggctcccaggctcctcatctttgatgtctttacaacgcgggcccctggccgtcccaggctaggttcaggtgcgaggtcggtntggggacagtaaccttcaactctacaccatcagcagccctagacgtactagtaaagttcgttttacgcgttaagttttactaacgttggttacaacgtccgagggtcgtcggtaccttacgggtttcgggcggtaggtccgtaccgttacggttccggggacgggtaacgggtaaaccctaaaaggtcgggttaaacgggttaaccgaaaaacggttcccgttagggcgggttccgttaggaacccaaaccttgttccttcgggttaccttaaccgttaactttcccccg

SEQ ID NO: 304800 - DNA, 532 bp, Homo sapiens
  misc_feature: GZ8MTXP01CAVXP.10.71.G05.1.454.CMB.2.raw
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccattcaccatctccagagacaattccaagaacatggtgtatctgcaaatgaccagcctgagagccgaggacacgggtntttatactgtgggagaaatcctagtgcatccacctggtatgtacttccggggcngggaccgtggtcacgtctctcggcctccaccaggcccatcggtcttccccnggccnccctgctccaggacgcgacctccgagacgcacgacgccggcccgtgggcctgcctggtcaacggacctaccttcccgaactacttagttcgctggagcgggcgtggcgaacggcgtcg

SEQ ID NO: 304801 - DNA, 608 bp, Homo sapiens
  misc_feature: GZ8MTXP01CQY92.10.71.G05.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaanagcccaccctctcctgcagggccagtcagagtgttcgctacttcggttagggtggtatcaacataaatccggcaggctcccaggctctnatcttgatgctttcaacncgggcccctggcctcccagtcgaggttcagtggcaggtgggtctggggacagaacttcnctctacaaccatcaagcaacgccctagacgcctagaacgtagttttgacttagttttattactgttacaggctagggtcgtcgtcctaacggtttccgggcggggtacggtcgtacccgtacgtttccgggacgggtaacggggaaaccaaaagtaacggaacggtaacaaacggtaaacgtggttacgggttcttacgtaaccaccgtaacgttctcggttctttcgaacgtttcccc

SEQ ID NO: 304802 - DNA, 583 bp, Homo sapiens
  misc_feature: GZ8MTXP01A0L54.10.71.G05.1.454.CMB.2.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (422)..(422): a, c, t, g, unknown or other
  misc_feature (422)..(422): n is a, c, g, or t
  modified_base (460)..(460): a, c, t, g, unknown or other
  misc_feature (460)..(460): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtggggggtccctgagctctcctgttcngcgtctggattcattctttagtaatctggcatgtcctgggtccncaggttccaggccacgggctggaatggggtgccagatatacaatatgaatgaactagtaaaatgtactatggagtactccgttacaacggggcctattcaacctatcctaccagaanactaaacttccgaaagaacctagtagggtatatcgtanacaaaatcggaacccaggcccaaggaacgacggtacccggaagggtacccgtacgggggtttattttaaccttacggtggttagggggaataaaacgttcccgttaagggtcggttctaaccg

SEQ ID NO: 304803 - DNA, 761 bp, Homo sapiens
  misc_feature: GZ8MTXP01AUILZ.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggaaancgccacctctctgcagggccagtcagagtgttcgctacgttcggttagggtgtatcaaacataaacgtccggacaggcctcccgaggccttcctctattcgtttagacttcgtacctttaccgaacgtaccgggggtccccctgggcccgttaccccgaggggtcctagggtttccagggttcggacgtagggttcgggggttactgggggaacctacggtaaccttccgaaccttcctaccgaacccgtacgtccgggacacggtacccctaggacgtaccgttaaggtaacgttattttcgactttaaggttttactacgtgtactagcgtaggcgggttacgtacccgttcggtttaccggggacgggtacgttccggtacccgttacgggtttccggggaccggggtaaacgggtaaaccctaaaaagggttcgggtaaacgggttaaacccgaaaacggttaccggtttggggaccggttaccgttcggacccgttaacctaacgtttccggttacgttaccctttccgtaaccttttccccggttaacccccg

SEQ ID NO: 304804 - DNA, 721 bp, Homo sapiens
  misc_feature: GZ8MTXP01A3B4I.10.71.G05.1.454.CMB.2.raw
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcggtgggggaggcgtgggtccggccggtcggggggtccctgagtactcctccgttgttcngcgtctggtattcatctttaagtaaatcgtggctagtcgtccggtgggtccccnccgtacggttcccgacggacccgacggggtcgtagggaaacgttgggggtcgacaagtaataataacgtaaatatgaatagaaacaaaaagttaaaatntaaactagaggtaactaccttccgttaacgaacgggcctaacttcaacccgattcccacaaagggaactaacctaaacgttaccccgaaaagtaaactagttagggttacgttaacttaccggtaaacgaaacgtaaacgtaccgaaaccgaccgtaccgtaaggaaccgggaccgtaacccgggtaaacggtaacggttaacgggttttattaaacggttacgggttaagggtaacgggttaaacgttaacgttccggtaaggtcgtaactacgtaccgttacgttaaggttaacgtcggg

SEQ ID NO: 304805 - DNA, 662 bp, Homo sapiens
  misc_feature: GZ8MTXP01C8EOZ.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggaggcgtggtccggccgtgggggtccctgacgctctcctgtccgcgtctggattcattcttagtaaatctggctagtcgtcccgtgggtccccgccgtacgggttcccagggccccacgggggcctgggaagtggggtggacagtataatacaaatactgatgaactaagtaaaaaatataactagtaggaactactaccgtacgaaacggggccctatttcaaccctaatcctaccaagaagaaacctaattaacccaaagtaacctagttaggttagttacttacgtagtaaacctaaacgtcgaaacccgagtcccgtaaggacggtaacggacccggaagggtaacgtaacggggtttagtttacgttacgttgggttaacgggtaagttaaaccgttccgttaaggtcgactaagttccaccggttgttaacgttcggtaacccggg

SEQ ID NO: 304806 - DNA, 782 bp, Homo sapiens
  misc_feature: GZ8MTXP01BLK2K.10.71.G05.1.454.CMB.2.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgcttgttctttgtcctccgaaggggaaancgcccaccctctcctgcagggccagtcagtagtgttcgctacgtttcggttaggggtgtatacaaactataaacgtccggccaggcctcccgaggtcctcctcattctttgagttgtcctttacgaaccggtaccgggtccccctgggtacccgtcccccgaggtccgtagggtttccaggttcggccgtaggtcggggtcgtaggggactaggtaaccctttcgaaccttcctaccaaccctacttccgacgacctaacgtacccgttaaggacgtacccgttaaggtaaagtttacgtttttacggacgttttaagttttaacctttaagtacggttaccaaggtacccgtagggggtccggtttaccggttaccgtttaccgggtttttcggggaccgggtacggggtttccgtaacccgtttaccgggttttccggggaacgggtaaacgggtaaacccgtaaaaaaggttacgggaaacgggttaaaccgaaaaccggttaacgttcgggttcgggttacttcggaacctaacgtcttcgttacgttcctttaaccgttaactttccccg

SEQ ID NO: 304807 - DNA, 614 bp, Homo sapiens
  misc_feature: GZ8MTXP01AQLZW.10.71.G05.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctntcctgcagggccagtcagagtgttcgctactttcggttaggggtgtaatcaaacataaatccggcaggctcccaggctcctcatctttgatcgctttacaacgagggcccctggccgtcccaggcagttcgtcgaggtcggcgtagggtcggtgtacgggactaacgtacttctactctaccactatacgacgacaccgtactacggacgtccgtaagtaagtttatttgactttacgtttaattacgtgtacgtagacggcggtcggtcgtacccgtttacggttcgggacgggtacggttccgtaccgttaccggttcggggacgggaacgggaaactaaaggttacggtacgaaacgaaacgtacggttgttaggctcgcaactagtcttcttcttctcc

SEQ ID NO: 304808 - DNA, 623 bp, Homo sapiens
  misc_feature: GZ8MTXP01BVD6O.10.71.G05.1.454.CMB.2.raw
  modified_base (584)..(584): a, c, t, g, unknown or other
  misc_feature (584)..(584): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtggtccggcgtgggggtccctgagactctctgttctgtcgtctggattctattctttaagtaatcgtggctatcgtccgtcgggtcccgccgtacggttccgacggccgacgggtcgtagggaagtggggtcggccagaataataactaataagtagaagtagaaacgtaaagttaaaataattaactaagtacgggaactaccttaccgttacggaacggggtaccctaatttacccgaccctatccctaccgaagaacgtaacctaaacgttacccgaaagtaactagtgggttatactcgtagaactaaagtcgaaccagccgtaagacgttacggaccgagtaccgtagggttnttagttacgtggtaggaataactccgttagtcgctaacg

SEQ ID NO: 304809 - DNA, 615 bp, Homo sapiens
  misc_feature: GZ8MTXP01EYFFI.10.71.G05.1.454.CMB.2.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagagtgttcgctacttcggttaggggtgtatcaacataaactccggccaggcctcccgaggcctcctcattctttgatgtcctttcaacgcggcccctggccgtcccgaggcaggttcaggtggcaggtgggtctggggacagtaaccttcaactctcaccatcagcagcctagacgctagaagtnttttagcttagtttatacgtgtacagtcgaggcgtgtccgtacgttcgggcggtaggtcgtaccgtacggtttcggggacgggtaacgggaaacctaaaagttcggaaacgggttaaccaaaacgggtaacgttcgggttacggttccgttacgtaacccgacctaagttcccgtggttacctttccgttcgtttaaccccg

SEQ ID NO: 304810 - DNA, 563 bp, Homo sapiens
  misc_feature: GZ8MTXP01EIRAC.10.71.G05.1.454.CMB.2.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcattctttagtaaatctggcatgtccgtgggtccgcaggtttccacggccacgggctggaatggggtgccagatatacaatatgntgacaagtaaatatactatgganactcttacgaaggccgattccactatcaccagagaacaatttaccgaaagtaactaattcgggtagtaactcgttagaacctaaatcgaacccagccctaagaacggagacccggaaggaccgtaacggggttgtttaagttacgtggtaggggaataaacgtccgttaagtcggcgtaacg

SEQ ID NO: 304811 - DNA, 616 bp, Homo sapiens
  misc_feature: GZ8MTXP01AKCJB.10.71.G05.1.454.CMB.2.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgcagggccagtcagtagtgttcgctacgttggttaggggtgtatcaacataaagtccggccaggcctcccgaggctccctctattctttgattgtcctttacgaacgcgggtccccctgggccgttacccgaggcgtaggttcaggtcggcaggtggggtatggggacagtaacttcaactcacacntcagcacgtcctagacgtccgtagaagttattttacgcttaagttttacttacgttgtacagtcaggggtcgtcgtcccgttacggtttcgggcgggtaggtcgacccgttacggttcggggacgggtacgggtaaaccaaagtcggaggtaccaaacggtacgtggcggttcttcgcgacctaagttctacgttcttcaacgttccccg

SEQ ID NO: 304812 - DNA, 641 bp, Homo sapiens
  misc_feature: GZ8MTXP01BB6GY.10.71.G05.1.454.CMB.2.raw
  modified_base (587)..(587): a, c, t, g, unknown or other
  misc_feature (587)..(587): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatgggtggagtcgtgggggaggcgtggtccggcgtggggggtccctgacgactctcctgttctgcgtctggtattctattactttaagtaaacttctggctagttcggtccgtcggggtccccgccgtacgggtttcccgacgggcccgacgggggtctagggaagtggggtgccaggaatagtaacaataatgaatagaaactaaagttaaaatataactagtaggactacttccgttaagaacggggtccctaatttaccaaccgttactacctacgaagaacgaactaaacgttaccaaaggtaacctagtcgggtatataccgtagaacaaatcgaacctagccctaaggaacgacggccgagggtaaccgtaggggtttntttagttaccgtaagggtgggaacgttaaagtcccggttaagtcggcttaaccg

SEQ ID NO: 304813 - DNA, 575 bp, Homo sapiens
  misc_feature: GZ8MTXP01EUQDR.10.71.G05.1.454.CMB.2.raw
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaaagagatgtccagtgtcagatgcagatggtggagtcgtgggggagcgtggtccggccgtggggggtccctggagactctcctgttctgcgtctggattcaattctttaagtaaatcgtggctatgtcctggggtccnccgaggttccagggcccagggctggaatgggtgcagatanacaataangaatgaaacaagtaaaaatataacatggaagactcttacgaagggccgattacaccatctaccgagaacgaacaaattaccaaagtaaacagtaggtgtaatcctagacaaatgaaccaacgccgtgaacgaggacccggaaaggaccgtaacggggttgttttaacttacgttaaggttgggaagtaaaatccgttaaggtcgaataacg

SEQ ID NO: 304814 - DNA, 576 bp, Homo sapiens
  misc_feature: GZ8MTXP01DHZNA.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagtatgtccagtgtcagatgcagatggtggagtcgtgggggagcgtggtccggcgtgggggtcctgagactctctgtctgcgtctggattcattctttagtaatctgctatgtccgtggtccgcaggttccaggccgacgggtctggagtgggtgcagatatacatatgaatgacaaagtaaatatactagtgatctaccgtagacgggcctattacactatctccaagataactattacccgaaagtaactagttcggtatattacgtagaacctaaagtcgaaccgtacgtccgtaagaacggacggacccgggaaggaccgtaacggggtttagttttacgttaccggtgggttaagggaacgttaaacgttccgttaaggttcggcttaacg

SEQ ID NO: 304815 - DNA, 607 bp, Homo sapiens
  misc_feature: GZ8MTXP01DKIH6.10.71.G05.1.454.CMB.2.raw
  modified_base (287)..(287): a, c, t, g, unknown or other
  misc_feature (287)..(287): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggccgtgggggtcctgacgctctcctgtctgcgtctggattcattctttagtaaatntggcatcgtcgtcgggtcccgcgacggttccacggccgacgggctggagtggggtgcagatatacaataatgaagtagaaactaaagtaaaaatataactagtggatactaccttacgaagggtccgtacttaccactatcctacagacaactaacttacgaaacgtaacgtaagtggttatacgtcgtagaactaaagtcgaacccacgccgtaaggaacggacggtccggaaacgggtaacgtacggggtttagttttacgttaaccgttaagggtaacggggaagttaaacgtccgttaaggtcggttaacttaacg

SEQ ID NO: 304816 - DNA, 611 bp, Homo sapiens
  misc_feature: GZ8MTXP01EAJ9E.10.71.G05.1.454.CMB.2.raw
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtgggtttcctcgttgctctttaagagatgtccagtgtcagatgcagatggtggagtcgtgggggagcggtggtccggcgtggggggtccctgagactctcctgttctgcgtctggattcatctttagtaatctggcatgtctgggtccgcaggttccagggtccagggctggaagtggggtggacccaggatactanaataagtgaacttgaaactaagtaaaatntaactattggaatacgtaccttacgaacgggcctaattaccacctaattcacccaggaactaaacaacttacctaaacgtaaactaagtagtagtactactagtacaaagtacgacacgccgtaacgagacggaccggacggaacgtaaccggggttacgggtttaacgtttacgttaagggttagggaacggtaaagtacccgttacggttaagggttaacggttaaccg

SEQ ID NO: 304817 - DNA, 577 bp, Homo sapiens
  misc_feature: GZ8MTXP01A25KK.10.71.G05.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgagggaaangccaccctntcctgcagggccagtcagngtgtcgcactttcggtagggtgtatcaacataaatccggcaggctccagctcctnatcttgatgtctttnaacgcggcccctggccgtcccaggctaggttcaggtggcaggtcggtntgggacagtaaccttcaactctccacatcgagcagcctagacgtccgtagaacgtattttggacttagtttattacgtgtacagtcagggtcgtcgtccgtacgtttcgggccggagtcgaccgtacgtttcgggacgggtaacggaacaaaagtcggaacggtacgaaacgtaacgtgttacggcgttcgcctacctaacgtcgtcgttacttccgttaacttccccg

SEQ ID NO: 304818 - DNA, 676 bp, Homo sapiens
  misc_feature: GZ8MTXP01BCRCH.10.71.G05.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtctccgaggggaaanacgccaccctctcctgcagggccagtcagngtgttcgctacgttggttaggggtgtatcaacataaatccggcaggctccaggctcctcatctttgatgctttcaacgacgggcccctgggccgtccccgaggtccaggttcaggtcggacgtaggtggggtcgtggggaactacggtaaccttcaacctctacaccatcaggcacgccctaggacgtccgtagaaacgttagttttagactttagttttaacttaccgttggttaccaaggtccgtaaggggtccggttacgtcccgttaacgggttttccgggacgggtacgggttcgtaccccgttacggtttccggggacgggtaacgggtaaaccctaaaaggtacggagggttaaaccaaaacgggtaacgttcgggttacgggcttacgggaacctaccgtcttacgttcggttaccttcgttaacctttccccg

SEQ ID NO: 304819 - DNA, 586 bp, Homo sapiens
  misc_feature: GZ8MTXP01DSFB4.10.71.G05.1.454.CMB.2.raw
  modified_base (247)..(247): a, c, t, g, unknown or other
  misc_feature (247)..(247): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgtttgctcttttaagagatgtccagtgtcagatgcagatggtggagtcgtgggggagcgtggtccggccgtgggggtcctgngctctctgttctgcgtctggattcattctttaagtaaatctggctatcgtccgtcggggtcccgccgtacgggtttcccaagggcccgacgggggccttggggaacgtgggggtggaccaaggtataataactaaattaatgaatagaactaaagtaaaatatactatggagtactccttacgaagggcctattcaccatcctaccagaagaactaacttaccgaaagaactaagttggtgtaacttctaggaacctaaagtcgaccgtacgcctaagacggagaccgaggaccgtggttagttnttacgtgagggtaanaacgtcttagtggctaacg

SEQ ID NO: 304820 - DNA, 633 bp, Homo sapiens
  misc_feature: GZ8MTXP01C3RRZ.10.71.G05.1.454.CMB.2.raw
  modified_base (267)..(267): a, c, t, g, unknown or other
  misc_feature (267)..(267): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcggtggtccggcgtgggggtcctgagctctctgttctgcgtntggattcattcttagtaaatctggctagttcgtccgtcgggtcccgccgtacggttccgacgggcccgacggggtctagggaagtggggtggacccaagtataatactaataactagaatagaaactaaagtaaaacttataactagtacggactacttccgtacgaaggggtcctacttaccgaacctatcctaccgaaagaacgtaaactaaaccgttaccgaaaacgtaacgtaacgttggtacgttaacttccgtagtaaactaaaagtcgaaccgtacgccgtaagacggacgccggaaggtacgtaagggtttacgtttattacggtgtagggtaataactccgttagtcgaacttaacg

SEQ ID NO: 304821 - DNA, 674 bp, Homo sapiens
  misc_feature: GZ8MTXP01C2HKJ.10.71.G05.1.454.CMB.2.raw
  modified_base (295)..(295): a, c, t, g, unknown or other
  misc_feature (295)..(295): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcacatggagtttgggctgagtcttgggttttcctcgttgcttcttttaagagtatgtccagtgtcagatgcagatggtggagtcgtgggggaggcgtggtccggcgtgggggtcctgagactctcctgttctgcgtctggattcattctttaagtaaatctggnagttcgtccgtggggtcccgcgaggttcccaagggcccgacgggctgggaagtgggggtggacctaggaacttataaacgtaaattaagtagaatagaaacgtaaaagtaaaaatattaaacgtatagggaacgtaccttacccgttacgaaacggggacctaattaccaacctacttccttaacccgaaagtaacgtaaaacctaaacgtttaacccaaaaggtaaaccgtaagttacgggttagttaactaccgttagaaaccctaaagtacggaaccctaagcccgtaaggaaacggcggaccggacggtaacgtacggggtttacgtttagttaacgttgggtagggtaaagtaactccgttaggtcggctaacg

SEQ ID NO: 304822 - DNA, 727 bp, Homo sapiens
  misc_feature: GZ8MTXP01AOYIG.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcggtcggtccgggccggtcgggggtccctgacgactctcctgttctgcgtctggtattcattctttagtaaatctggctatcgtccgtcggggtcccgcgtacggttccgagggtcccgacggggtctagggaagtggggtacggaccgaaggtattaacgtaactaaattaaagttagaagtagaaacctaaaaggttaaaaaacttacttaacgtaaagttacgggtaacgtaacccgtttacccgtttaacggaaacggggtcccttaatttaccccgaaccctaacttacccgtaacccgaaacgtaacggtaaacctaaactttaaccccggaaaagtaaaccgtaagttacgggttaagttaacttacgttaacggaacctaaaacgttcgaaacccgagtccccgtaaggaacgttacgggaccgagggtaacccgtaggggtttacgttaacgttaggtggtagggaattaacgtcgttaggtcgaactaaccg

SEQ ID NO: 304823 - DNA, 586 bp, Homo sapiens
  misc_feature: GZ8MTXP01BESBI.10.71.G05.1.454.CMB.2.raw
  modified_base (206)..(206): a, c, t, g, unknown or other
  misc_feature (206)..(206): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctgtctcccagacaccaccggagaaattgtgttgacacagtctccagccacgctgttctttgtctccgaaggggaaancgccaccctctcctgcagggccagtcagagtgttcgctacgttcggttaggggtgtatcaacataaatccggcaggctcccaggctcctcatcttgatgctttcaacgcgggcccctggccgtcccaggcctaggttcaggtggctaggtgggtctggggacaggtaaccttcaactctacacccatcagcagcctagacgctgtaacgtattttgcttagtttactactgtacagtcagggcgttagcctacgtttcgggcggtaggtcgccgtacgtttcgggacggaacgggaactaaaagttggacggttacgaaacggtaacgtggttacggcttcggcctacgtaatccgttagttccttcgttaacttccccg

SEQ ID NO: 304824 - DNA, 697 bp, Homo sapiens
  misc_feature: GZ8MTXP01CTJ8Q.10.71.G05.1.454.CMB.2.raw
  modified_base (254)..(254): a, c, t, g, unknown or other
  misc_feature (254)..(254): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgtgggttttcctcgttgctcttttaagagatgtccagtgtcagatgcagagtggtggagtcgtgggggagcgtggtccggccgtgggggtccctgagactctcctgttcngcgtctggtattcatctttaagtaatctggcagtcgtccgtgggtcccgccgtaggttcccgacgggtcccgaacgggggtcgtagggtaaaggttgggggtaggaccgaaggtaattaagtaaaccgtaaattagttaggaacttaaggaaacctaaaaaggttaaaaaattaacttaaacgtaaggtacgggtaaacgtaccttacccgtttaacgaaacggggtccctaattaccacctacttacctaccgaagactaaactaaacttaccaaaagaactagttacggtagttacctactagaaactaaatacggaacccagttacccgagaaggacggaccggaggtaaccgtagggtttagtttaaattcggtaggtaggaaaggttacttacgtaaggtggtaactactccgttaccgttggttaagttttccgggg

SEQ ID NO: 304825 - DNA, 700 bp, Homo sapiens
  misc_feature: GZ8MTXP01AZ8SC.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcgtggtccggccgtgggggtccctgagctctcctgttctgcgtctggatttcattctttaagtaaacttcgtggctagttcgtcccgtcggggtcccgccgtagggtttccccagggtcccgaacgggggtcttagggaagtgggggtggcccaaggtataataacgtaataaatgaatagaaacaaagtaaaattataactaagtaggtaactaccgttaccttaacggaacggggtacctaatttacccaaccctatccctaacccgaagaacgtaaacctaaacgtttaccaaaacgtaaactagttacgggttaagttaactccgtaagaactaaaacgtccggtaaccacggtcctaaggacggaacgggacccggagggtaaacccggtacggggtttaagttttaggttaccgtggggtaacgggtaaagttaaacgttcccgttaaggtccgggttaacttaaccgg

SEQ ID NO: 304826 - DNA, 805 bp, Homo sapiens
  misc_feature: GZ8MTXP01CCTGX.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagtcgttgggttttcctcgttgcttcttttaagagatgtccagtgtcagatgcagagtggtggagtcgtgggggagcggtcgggtcccggccggtggggggtccctggacgtactctcctgttctgcgtctggtattcattactttaagtaatcgtggctagtcgtccgtcggggtccccgccgtacgggtttcccgacgggtcccgaacgggggtcgttaggggaacgttggggggtcggacccgtaaggtaattaaactaaacgtaaattaagttaggtaagttaggtaaaaccgtaaaagtttaaaaaattacgtttaaacgtaaagttacgggtaaacgttaccctttacccggtttaacggaaaccgggggtacccttaactttaccccgaacccgttaacttccctaacccgaaagaaccgtaaacctaaaccgtttacccggaaaagtaaaccgtagttagggttagtaacttacgtacgtaaactaaacgttcggaaacccctacggtcccgtaagggaacggaccgggtacccgggttaacgggtaaacccggttacgggggttttagttttaacggttacggttaaggggttaaggggtaaaccgttaaacggtcccggttaaggggttcgttaaccgttaacgg

SEQ ID NO: 304827 - DNA, 777 bp, Homo sapiens
  misc_feature: GZ8MTXP01DJFL1.10.71.G05.1.454.CMB.2.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttacttttaagagtatgtccagtgtcagatgcagatgggtggagtcgtgggggagcggtggtccggcgtgggggtccctganctctcctgttcngtcgtntggtattctattctttaagtaaactcgtggtactagttcggtccgtcggggtccccgaccgtacgggttccacgggtcccgaacgggggtctagggaagtcggggtggacccaaggtataataacaaattaatagaatagaaactaaaagttaaaatacttaacgtagtacgggtaacgtacccgttacccgttacgaaacggggtacctaactttaccaacccttactacccgtaacccgaaaggtaacgtaaacctaaacgtttaaaccccggaaaacggtaaaccgttaagtttagggttaacggttaacttaccggttacgtaaaacctaaacgttaccgaaacccgacggtaccccgttaagggaaacggaaccgggaccccgggttaaaggggtaaacccgttagggggtttttaacgttttaacggttaaccggttaaggggttaccggggtaaaagttaaaccgtcccggttaaaggttcgggttaaccttaaaccgg

SEQ ID NO: 304828 - DNA, 609 bp, Homo sapiens
  misc_feature: GZ8MTXP01D0H5Z.10.71.G05.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
  modified_base (380)..(380): a, c, t, g, unknown or other
  misc_feature (380)..(380): n is a, c, g, or t
  modified_base (579)..(579): a, c, t, g, unknown or other
  misc_feature (579)..(579): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtctccgaggggaaanacgccaccctctcctgcagggccagtcagngtgttcgctacgttcggttagggtgtanacaacataaatccggcaggctcccaggctcctcatcttgatgtctttacacncgggcccctggccgtcccgaggctaggttcagtggctaggtgggtacgtgggactagtaaccttcnctctccaaccatcagcacgcctagacgctagtagttatttgacttagtttatactgtacagctaggggtcgtcgtacctacggtttcgggcggtaggtcgtaccgtacggtttcgggacggtaacgggaaaccaaaaggttacgggaacggtaaccgaaaacggtacgtcggttcgggttcttacggaaccctaacgtnttaccgtcgttcctttcaaccgtttccccg

SEQ ID NO: 304829 - DNA, 522 bp, Homo sapiens
  misc_feature: GZ8MTXP01AXSWB.10.71.G05.1.454.CMB.2.raw
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtcctgagactctcctgttctgcgtctggattcattctttagtaaatctggcatcgtccgtgggtccgcctagggttccagggcccacgggctggaagtggggtgccagatanacataatgctgaaacagtaaatatactangagactctagagggcctatacaccatcacaganacaatccaagaacngtcggtntatcngacaaatagacaacgcncgagagacgacggacgtacgggttgtttagttacgtgtggtaaggaatacgttacgtgcgtaacg

SEQ ID NO: 304830 - DNA, 637 bp, Homo sapiens
  misc_feature: GZ8MTXP01BSO8B.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagagtgggtggagtcgtgggggaggcggtgggtccgggccggtcggggggtccctggacgtactctcctgttctgcgtctggtattctattactttaagtaatcgtggctagtcgtccgtcggggtcccgtaccgtacgggttcccgacgggcccgaccgggggtcgtagggtaagtgggggtagaccaaggtattaagtaacaaataatgaatagaaactaaagttaaaatacttaagtagtaggaactactaccgttacggaacgggtccctattacccacctacgtcctaccgaagaacgtactaaacttaccgaaagtaactagtggttatactcgtagaacctaaatcgaccacgtccgaagaacggcgaccggaggtacgtcgggttagtttgttacgtgggtaggaataacgtcgttagtgctaacg

SEQ ID NO: 304831 - DNA, 747 bp, Homo sapiens
  misc_feature: GZ8MTXP01ET9Q8.10.71.G05.1.454.CMB.2.raw
  modified_base (719)..(719): a, c, t, g, unknown or other
  misc_feature (719)..(719): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtcctccagccacgcttgtctttgtcctaccggaaggggaaaacgcgccccaccttcctcctgcgagggccagtcagtagttgttcgctacgtttcggttaggggtgtatacaaactataaacgtcccggaccacggcctccccgaggtccttacccgtctactttccgttttagacttcggttcctttaaccgaaacccggtcggccccccgttagggtccccgtcccgtaacgggtccgtagggtttccgaagggttcgggacgtacggggttcgggggtcgttacgggggacctacggtaaccctttacaacccttccctaccacctaacgtcgaacggaccacgtacccgttaaggacgtaccgttaaggtaagttagttttacggactttagttttacgttacgttcgttacacggtcgtacggggcttcggtccgtaccggtttcggggcgggtacggttccggtccgttaaccgggttcggggaacggtaacgggtaaactaaaggtacggttaacggtaacgaacgtacggtttccgagcaaccngtcctcgtcttcctaacgttcgttcccg

SEQ ID NO: 304832 - DNA, 651 bp, Homo sapiens
  misc_feature: GZ8MTXP01B10NQ.10.71.G05.1.454.CMB.2.raw
  modified_base (355)..(355): a, c, t, g, unknown or other
  misc_feature (355)..(355): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtccctgagctctcctgttctgcgtctggattcatctttagtaaatctggcatgtccgtgggtccgccaggttccaggccacgggctggatggggtgccagatatacataatgntgacagtaaatatactataggatacttccttacgaagggtcccgatttaccaacctattccctacccaagaacgaacctaaacttacccgaaaagtaaacctagttacgggttgttaacttcccgttaggaacctaaaacgttcgaaaccccgtaggaccccttaagggaacggacgggacccgggaaagggtaacccggttacgggggtttacgtttttaagtttacccggttaaggggttacgggggtaaacggttaaaaacttcccggttaagggttcggccggttaaacccg

SEQ ID NO: 304833 - DNA, 595 bp, Homo sapiens
  misc_feature: GZ8MTXP01BOSHH.10.71.G05.1.454.CMB.2.raw
  modified_base (274)..(274): a, c, t, g, unknown or other
  misc_feature (274)..(274): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagttttgggctgagcttgggtttttctcgttgcttcttttaagagatgtccagtgtcagatgcagatggtggagtcgtgggggaggcgtggtccggcgtggggggtccctgagactctcctgtctgcgtctggnttcattctttaagtaaatctggctatcgtcctgggtcccgcctagggttccagggccacgggggctgggaacgtggggtgccaggataatacaataatgaatagaaactaaagtaaaatataactagtaggagtacttccgttacgaaggggcctattaccacctatacctaccaagacgaactaaacttccgaaagtaactagtaggtagtatcgtagaacaaagtcgaccaacgcctaaggacgacggacccgaaggaccggtacgggtttagtttacgttacgtggtagggaactaaagtccgttaaggtcgctaacg

SEQ ID NO: 304834 - DNA, 813 bp, Homo sapiens
  misc_feature: GZ8MTXP01A1N52.10.71.G05.1.454.CMB.2.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcgtggtccggcgtgggggtcctgagctctcctgttcngcgtcnggtattctattctttaagtaatcgtggctatcgtccggtcgggtccgacccgtacggttccgaggcccgacggggtcgtagggtagtggggtgaccctaaggatataacgtaataagtagaattacgaaacgtaaagttaaaaactagttaacgtaaggttacgggaaaccgttacccgttaccccggtttaaacgggaaaccggggggtaccccttaaacgtttaacccccaaacccggttaaccgtttacccctaacccggaaaacgggtaaaccgtaaaacccttaaaaccgtttaaaccccgggaaaagtaaacccggtaggtttaggggttaacgttaacttaccgttaacggaaacctaaaagttacccgggaaccccttaaacgggcccgttaaagggaacgggaaacccgggacccgggttaaacggggttaaaccccggttaagggggttttacttttaaacgttaccgggttaagggggtaacggggtaaactaaaaccggtttcccggttaaaggtcggttaaccttaacccgg

SEQ ID NO: 304835 - DNA, 563 bp, Homo sapiens
  misc_feature: GZ8MTXP01AEM6A.10.71.G05.1.454.CMB.2.raw
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (473)..(473): a, c, t, g, unknown or other
  misc_feature (473)..(473): n is a, c, g, or t
tcagcatagtagtgcacgaccggtgctcgatttagtgtcgtcgcaagagagagggggagctctgggagaggagcccagcactagaagtcggcggtgcccccattcggtgatcagcactgaacacagaggactcaccatggagtttgggctgagctgggttttcctcgttgctcttttaagagatgtccagtgtcagatgcagatggtggagtcgtgggggaggcgtggtccggcgtggggggtccctgagactctcctgttctgctcnggnttcatctttagtaaatctggcatgtcctgggtcccgcaggttccaggtccgacgggctggagtgggtggcagatanacaatntagatgactaagtaaatatactataggactactccttacgaacgggacctattacacctatctaccaagacaaacaacttaccaaaggtaacagtgtagtattcagacaaatgacccaancccgtagaaggacgacggtaggaccgtacggggtatttacgttcgttgggtaagggagtaaactccgtaaggttggtccaagttaaccgg

SEQ ID NO: 304836 - DNA, 551 bp, Homo sapiens
  misc_feature: GZ8MTXP01ETDQN.10.71.G05.1.454.CMB.2.raw
  modified_base (299)..(299): a, c, t, g, unknown or other
  misc_feature (299)..(299): n is a, c, g, or t
  modified_base (432)..(432): a, c, t, g, unknown or other
  misc_feature (432)..(432): n is a, c, g, or t
tcagcatagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactcttcaaggccattcacatctcagagacaattccaaagaacatggtgtatctgacaaatgaccagcctgagagcgagacacggtntttatactgtagggagaaatccgtagtggcatccacctggtatgtcgtaaccgttccggggcaggggtaaccgtcgggtcaccgtctcttccggccctcaccaagggcccagtcgttcctcccgtgccgcctnctcaggacgcaccgtccgagacgccacgacgccgggcccgtggggcctcggccgtggtcaaggtacttaccgtccctaacttacgttattcgctggaagcgggtcgttgtcgaagggcc

SEQ ID NO: 304837 - DNA, 598 bp, Homo sapiens
  misc_feature: GZ8MTXP01EU7SF.10.71.G05.1.454.CMB.2.raw
  modified_base (379)..(379): a, c, t, g, unknown or other
  misc_feature (379)..(379): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtggttttcctcgttgctcttttaagagatgtccagtgtcagatgcagatggtggagtcgtggggagcgtggtccggcgtgggggtccctgagactctcctgtctgcgtctggtattcattctttaagtaaatcgtggctatcgtccgtcgggtcccgccgtacggttcccgacggtcccgacgggcgtggaagtggggtagacccaggtaatagtaacaagtaanaggaattagaaactaaagttaaaatataactagtaggtataccttcctacgaacgggtcctattaccaccctatccaccgaatacgtaaactaacttaccaaagtaaacctgttagtagtactcgtagaacaaagtcgactacgcgngaacgnggaccgaggaaccgtagggttatttcgttagtggtaggtaagtaacttcggttagtgttccgtaag

SEQ ID NO: 304838 - DNA, 821 bp, Homo sapiens
  misc_feature: GZ8MTXP01ASX47.10.71.G05.1.454.CMB.2.raw
tcagcatagtagtgcacgaccggtgctcgatttagtgtcgtcgcaagagagagggggagctctgggagaggagcccagcactagaagtcggcggtgccctccattcggtgatcagcactgaacacagaggactcaccatggagtttgggctgagcttgggttttcctcgttgcttcttttaagagatgtccagtgtcagatgcagatgggtggagtcgtgggggaggcggtgggtccggcgtcgggggtccctgagtctctcctgttctgcgtcgtggtattctattctttaaagtaacttcgtggctagttcggtccggtcgggtccccgccgtacggttccgacgggcccggtacgggcgtagggaaggtggggtcgaccgagtataagtaacaaataagtagaatagaaactaaagttaaaactattaacgtagtacgggaacttacccttaccgttaacggaaccgggtccttaacgttaaccccaccttaacttcccgaaacccgaaagtaaaccgtaaaccttaaaacctttaaacccggggaaaaacgtaaaccgttaaggtttacggggtttaaacgttaaccttaccgttaggaaaaccgttaaaaaccgttccgggaaaaccctacggtaccccggtaagggaaaaccggaccggggaaaccccggggttaaacggggtaaacccggggtttaaacggggggttttaattttttaaacggttacccgggggttaagggggtttaaacggggaaaaccgttaaaaccgtttcccggttaggggttaacccgggttaacctttaaaacccggg

SEQ ID NO: 304839 - DNA, 815 bp, Homo sapiens
  misc_feature: GZ8MTXP01EFHZN.10.71.G05.1.454.CMB.2.raw
  modified_base (264)..(264): a, c, t, g, unknown or other
  misc_feature (264)..(264): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggtttcgtcgttagctctttaagagatgtccagtgtcagatgcagatggtgagtcgtggggagcggtggtccggcgtgggggtcctgagtctctctgtctgcgtctgnttcattctttaagtaatcgtggctatcgtccgtcggtcccgacgtacggttccgacgggcccgtacgggggcgttagggaaaggttgggggtacggacgaaggtaattaagtaaacctaattaaagtagtaaggttaccgaaaactaaaaggtttaaaaacttattaaaccgttagggttacgggtaaaccgtaaccctttacccggtttaacggaaacgggggttccctaaacttttaccccgaaaccttacgtttaccccgtaaaccaaaggaaacgtaaaacccttaaaaccttttaaccccgggggaaaaacttaaaacggtttaaacggtttcggggttaaacgtttaattacccgggttaaaacgtaaacgtaaaccgtaaccgtaaaccgtaaccggtaaccggtaacggtaaacggaaccgggtaaccgggttaaaccgggttaaaccgggtttaacgggttttacggttttaacggtttaacgggttaagggttaacgggtaaacggttaaacgttacggttacggtaacgttaacgtaacg

SEQ ID NO: 304840 - DNA, 899 bp, Homo sapiens
  misc_feature: GZ8MTXP01DEO83.10.71.G05.1.454.CMB.2.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaagacgccaccctctcctgcagggccagtcagtagtgtcgctacgttcggttagggtgtatacaacataaacgtccggcacggcctcccgaggtcctcctctattctttgattcgtacctttacgaaccgtaccggggtccccctagggcccgtccccgagggcctaggggtttacaggttcgggaccgtaggggttcgggggttacgtagggggaaccctacgggtaaaccctttccgaaccttcctaccgaaaccctactaccgaacggtcccaaacggtaccccttaagggaaccggtacccgttagggtaaaacgtttacgtttttacgggtaccttttaagggtttttaacctttaccgttacgggttaaccgtaacggtacccggttaacgggggttccccggtttaccgggttaaccccgtttaacccggggtttttccgggggaacccgggggttaacggggttttaccccgggtaacccccggtttaacccggggtttttaccggggggaaaccgggggtaaaaccgggggtaaaaccccgttaaaaaaagggttacggggttaaacgggttaaacccgaaaaaccgggtttaaccggttacggggttaccgggttcgtttaaccggaacccgtaaaccttaacgttcccgttacggtttaccctttaaccgttaacccgttttcccccg

SEQ ID NO: 304841 - DNA, 812 bp, Homo sapiens
  misc_feature: GZ8MTXP01C9CS2.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgttgggttttcctcgttgcttcttttaagagatgtccagtgtcagatgcagatggtggagtcgtgggggagcggtggtccggccgtgggggtccctggacgtactctcctgttctgcgtctggattcattctttaagtaaatctggcagttcgtccgtcgggtccgccgtacggttcccacgggtcccgacggggtccgtagggtaaagtgggggtacggacccgaggtaagttaagtaaaccaaagttaaagtaggtaacgttaagtaaaccgtaaaaggttaaaaaactaattaaaccgttaaagtacggggtaacttaaccgttacccgtttacggaaaaccgggggtcccgtaaactttaccgaaccccttaattacccttacccgaaagggaacgtaaaacctaaacctttaaccggaaaaacggtaaccgtaaagtttcggggtaagttaacgtaccctttaaggaaacccgtaaaattaccggtaaaccccgtaagggccccgttaaggaacgggttaaccgggaaccccgggttaaaggggtaaaccccgtacggggggttttaacttttaacggttaacggttcggggtaaacgggggttaataaaaccggtttccgggttaaaggtcggggttaacctttaaacccggg

SEQ ID NO: 304842 - DNA, 612 bp, Homo sapiens
  misc_feature: GZ8MTXP01BR17I.10.71.G05.1.454.CMB.2.raw
  modified_base (563)..(563): a, c, t, g, unknown or other
  misc_feature (563)..(563): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagagactcaccatggagtttgggctgagtcttgggttttcctcgttgcttcttttaagagtatgtccagtgtcagatgcagagtgggtggagtcgtgggggaggcggtgggtccgggccgtggggggtccctggacgtactctcctgttctgcgtctggtattcattctttaagtaaatcgtggctagtcgtccgtcggggtcccgccgtacggttcccgacgggcccgacgggggtctagggaagtggggtggcccaggtataataacaattaatagaatagaaactaaagtaaaactataactagtaggagtactcttacgaaggcctattccactatccacagacgaactaacttaccgaaagaactagtggtatatctagaactaaagtcgaaccagccgtaaggaacgacgaccggaggtaacgtaacggggttntttagttacgtggtagggtaataaacgttcgttaaggtcggcgtaaccg

SEQ ID NO: 304843 - DNA, 744 bp, Homo sapiens
  misc_feature: GZ8MTXP01EOMZX.10.71.G05.1.454.CMB.2.raw
  modified_base (259)..(259): a, c, t, g, unknown or other
  misc_feature (259)..(259): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttggctgagcttgggttttcctcgttgcttcttttaagagatgtccagtgtcagatgcagatggtggagtcgtggggagcgtggtccggcgtgggggtccctgagactctctgttctgcgtctgtntcatcttagtaatctggctatgtccgtcgggtcccgccgtacggttcccgaggccccgaacgggggtcgtagggaacgttgggggtaggacgaagtaacttaagtaactaaattagtagtaatacggaaactaaaaagttaaaaaattaacttaaacgtaagtagggtaacgttaacccgttacccgtttacgaaaacgggggtccctaaatttaccccaaccctaacttacccttaccgaaacgtaacgtaaactaaacttaacccgaaaacgtaaactaagtttacgggttaggttaacttcgttaacgaactaaaagttccggaacccgtaaggacccgttaggtaacggaacggtacccgggaagggtaaccggtacgggggttttagtttttaaagttacgttgggttaagggacgttaaaacgtttccgtaaggttcggtaactcgtaccgttaccgttaaggtttaacgtttccgggg

SEQ ID NO: 304844 - DNA, 628 bp, Homo sapiens
  misc_feature: GZ8MTXP01A2G9E.10.71.G05.1.454.CMB.2.raw
  modified_base (205)..(205): a, c, t, g, unknown or other
  misc_feature (205)..(205): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (593)..(593): a, c, t, g, unknown or other
  misc_feature (593)..(593): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgcttgtctttgtctccgaaggggaaancgcccaccctctcctgcagggccagtcagagtgttcgctacgtttcggttagggtgtatacaacataaactccggacaggcctcccaggctcctctattctttgatcgtcctttacgaacgtacgggtcccctgggcccgtccccgaagggctaggttcaggtggctagggtgggtctggggacagtaaccttcgaactctcaacctatcgagcacgcctagngcctagtaacgttnttttacgcttagtttactactcgtacagtccgagggtcgtctaccgtacgtttcgggcggtacgtcgtaccgtacgttcggggacggaacggtaaacctaaaggtcggaacggtaaacaaacggtaacgtggttacggttcttcggaaccncgtaacgttctcgttccttaacttaacgttccccg

SEQ ID NO: 304845 - DNA, 819 bp, Homo sapiens
  misc_feature: GZ8MTXP01EA36E.10.71.G05.1.454.CMB.2.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgcttgttctttgtctccgaaggggaaanacgccacctctcctgcagggccagtcagagtgttcgctacgtttcggttaggggtggttaatcgaaactaataaacgtcccggaccacggcctcccgaggccttccctctaattcgttttgaattcggtaccttttacgaaacccgtaccgggggtccccccttgggggaccccgttacccccgaagggtccctaaggggttttccaagggtcgggtaccgtaaggggtttcgggggtaccgtagggggaaccctaaggtaaccctttaccaaccttccttacccaaacccctagttacccgaacgggtacaaacggtaccccgttaaaggaaccggtacccgttaggtaaaacggttacgttttttacggaccgtttaagtttttaacgttaacgttcgtaccgtaagtaccgtaacggggtccgttccggtacccttaccgggtttccgggacgggtacggttcgacccgttacgtttaccggggaccggtaaacgggtaaaccgtaaaagttcgggaaacggtaacccgttaaaacggtaccgtgggttacggcgttacgaaccctaacctaacgttccgtcggtttaccttcgttaacgtttccccgg

SEQ ID NO: 304846 - DNA, 650 bp, Homo sapiens
  misc_feature: GZ8MTXP01EBWIO.10.71.G05.1.454.CMB.2.raw
  modified_base (421)..(421): a, c, t, g, unknown or other
  misc_feature (421)..(421): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagtcttgggttttcctcgttgcttctttttaagagtatgtccagttgtcagatgcagatggtggagtcgtgggggaggcggtcgggtccggccgtgggggtccctgacgtactctcctgttctgcgtctggattcgattctttaagtaaatctggctatcgtccgtcgggtcccgctacgggttcccagggtcccgacggggtcgttaggaagtggggtcggccaaggtaatagtaacaattaagtgaatagaaactaaagttaaaaatntaacttagtacggtaacgtacttaccgttacgaacgggtcctatttaccaccctaatcctaccgaacgaacgaactaaacgttaccgaaacgtaactagttagggtacttataccgtagaaacctaaagttacggaccctaaggcccgtaaggacgacgacccggttaggtacgtacgggttagtttacgttagtggtaggaagtaactccgttagggtaacgctaacg

SEQ ID NO: 304847 - DNA, 616 bp, Homo sapiens
  misc_feature: GZ8MTXP01B0XX7.10.71.G05.1.454.CMB.2.raw
  modified_base (376)..(376): a, c, t, g, unknown or other
  misc_feature (376)..(376): n is a, c, g, or t
  modified_base (499)..(499): a, c, t, g, unknown or other
  misc_feature (499)..(499): n is a, c, g, or t
tcagcatagtagtgcacgaccggtgctcgatttagtgtcgtcgcaagagagagggggagctctgggagaggagcccaacactagaagtcggcggtgcctccattcggtgatcagcactgaacacagaggactcaccatggagtttgggctgagcttgggttttcctcgttgcttcttttaagagtatgtccagtgtcagatgcagagtgggtggagtcgtgggggaggcggtgggtccggccgtgggggtccctgcgactctctgtctgcgtctggtattctattctttaagtaaatctggcagtcgtcccgtgggtcccgccgtaggttcccgacggccgacgggtcgtggaagtggggtggcagtatacgtaanaatagtgaatggaaactaaagttaaaatataactaggtacggtaactaccgttcctaacggtacgggacctaattccaaccattccaccgagacgaacaattccgaaaggactagtgttagtntccgagactaaactcgtaccaagtccctgaacggcgttacggaacgggttacgtacgggttattttaacgttggttaggaagtaagtaactcggagttcgggtcttaagttaacccg

SEQ ID NO: 304848 - DNA, 779 bp, Homo sapiens
  misc_feature: GZ8MTXP01B160E.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcggtgggggaggcggtgggtccggccgtcggggggtcctgagactctcctgttctgcgtctggtattctatctttaagtaattcgtggctagtcgtccgtcgggtcccgccgtacggttccgacgggccgacgggcgtaggaagttggggtggcagtatatacaaatatagatagaactaaaagttaaaacttaataactagtagggtaacgttaccttacccgtttaacgaaacggggcccttaacttacccaaccctattacccaccgaaacgtaacgtaaacctaaaccttacccggaaaactaaccgtaaagttcggggttattaacgttaccgttaaggaaacccgtaaaaagttacccggaaaccccgaagggtaccccgttagggggaaaaccggtaaccggggaccccgggggtaaaacggggttaaccgggttaaaccgggggttttttagtttttaaacgtttaaacccgggttggggtaaaggggttaaaccgttaacgtttacccgtaagggtacgggtaacctacgttaccgttacccggtttggtttaacgttttccgggg

SEQ ID NO: 304849 - DNA, 657 bp, Homo sapiens
  misc_feature: GZ8MTXP01AFN5B.10.71.G05.1.454.CMB.2.raw
  modified_base (263)..(263): a, c, t, g, unknown or other
  misc_feature (263)..(263): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcggtggtccggccgtgggggtccctgagctctcctgttcngcgtctggtacttcattctttaagtaactctggctagtcgtccgtgggtcccgcgtacggttcccgagggcccgacgggtcgtagggaagtggggtcggaccaggtataataacaatatagaatgaaactaaagtaaaatataacgtagtacggaacgtaccttccgtacggaacgggtcctaattcccgaacctagtaccctaccgaaagaaccgtaacctaaacgttacccgaaagtaaacgtgttacgggtattacgtcctaggaaactaaacgtcggaaaccctcggccctaagaacggacggacccgggaggtaaccgttacggggtttagtttattaccggtaagggtacgggtaactaaagttccggttaggttcggaacttaaccg

SEQ ID NO: 304850 - DNA, 629 bp, Homo sapiens
  misc_feature: GZ8MTXP01ANL5M.10.71.G05.1.454.CMB.2.raw
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (563)..(563): a, c, t, g, unknown or other
  misc_feature (563)..(563): n is a, c, g, or t
  modified_base (598)..(598): a, c, t, g, unknown or other
  misc_feature (598)..(598): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggtttttcctcgttgcttcttttaagagatgtccagtgtcagatgcagatgggtggagtcgtggggggagcggtgggtccggccgtgggggtccctgacgtactctcctgttcngcgtctggattcatctttagtaatctggcatcgtcctgggtcccnccgaggttccagggccgaacgggctagggaactgggggtagcagaataagtacaattagtgtaagtagaactaaaagttaaaattctaactagtacgggactaacgttcccttacgaaacgggtccctaattaccactacttccaccgagtaacgaactaaacttacccaaaaggaaccagtttacggtacgttaatccgtagaaccaaagtcgaaacctagacccgtagacgacgaccggtaggaacgtagggttnttagttagtaggtagacgttaaattcccgttaagngtcctataccgttccgttggttaaccgttgg

SEQ ID NO: 304851 - DNA, 764 bp, Homo sapiens
  misc_feature: GZ8MTXP01DGZ6R.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaancgcccaccctctcctgcagggccagtcagtagtgttcgctacgttcggttagggtgtatcaactataaactccggcaggcctcccgagcctctctattcttgatgtctttacgaacgcggtcccctggcccgtcccgaggctaggtttccaggtcggcgtagggtcggggtacgtaggggacctaggtaaccctttaccgaaccttcctacccaacccgtacttaccgacgtacctacgaccctaaggaccgtaccgtaaggtaaagtttacgttttagtaccgtttaagttttaacttacgttacgttacgaacggtccgtaacggggttccgttacggttaccccgttaaccgggtttccgggggtaaccgggttacgggttaccggttaccccggttaaccgggttttaccgggggaccgggtaaaacggggtaaacccgtaaaaaaggttaacgggaaacgggtttaaaccgaaaacgggtaaccggttggttaccggttcgttaccggaaccgtaaccctgttccgtacgtttaccttcgttaacccgtttccccg

SEQ ID NO: 304852 - DNA, 640 bp, Homo sapiens
  misc_feature: GZ8MTXP01DTZD7.10.71.G05.1.454.CMB.2.raw
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtgagtcgtggggagcgtggtccgcgtggggtcctgnctctctgtctgcgtctggattcattctttaagtaatctggctattcgtccgtcgggtccccncgtaggttccacgggtcccacgggggcttaggaagtggggtgacctagattaatactaataatgaatagaaactaaagtaaaatataacgtatacgggactaactccgttacgaaacgggcctaataccactatctaccagaactaactaacttacgaaacgtaactagttagggtattaactcttaggaaacctaaagttacgtaacccgacgtcccgttaacggaaggaccggacccgggttaaagggtaacccgttacgggggttttactttaacgttacggttgggtaaaggggttaactaaacgtaccggttaggttaacggccttaaccgg

SEQ ID NO: 304853 - DNA, 572 bp, Homo sapiens
  misc_feature: GZ8MTXP01A2F85.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtgagtcgtgggggagcgtggtccggcgtgggggtccctgagactctcctgttctgcgtctggattcattctttagtaaatctggctagtcgtccgtgggtcccgccgtacggttccaggccgacgggctggaagtgggtgccaggatatacaataatgaatagaacaaagtaaactatactataggatactcttacgaagggccattacacagtccacagacgacaacttaccgaaagacagtggtatactctagactaaactcggaacccagcctaagaacgacggacccgaggaaccgtagggggtttctttagttaccgtgggtagggtaacaaacgttccgttaaggtcggaactaaccg

SEQ ID NO: 304854 - DNA, 633 bp, Homo sapiens
  misc_feature: GZ8MTXP01B04NB.10.71.G05.1.454.CMB.2.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacnccaccctctcctgcagggccagtcagagtgtcgctacgttcgtagggtgtancaacataaagtccggcaggctccagctcctcattcttgatgtctttacaacgcgggcccctggccgtcccgaggctaggttcaggtggcgtaggtcgggtcgtggggactcgtaaccttcncgtctcacctatcagcacgcctagacgtctagtaattnttttgacttaagttttactacgtcgtcaagtccgagggtcgtcggtccctacggtttcggggacgtgggtcgtacccgttcggttccgggacggtaacggggtaaaccaaaaggttacgggaacgggttaaccgaaaacgtaacggttcggttacgggccttacggaaccctaacccgttcgtttccgttcgtttacccttcgttaacccgttccc

SEQ ID NO: 304855 - DNA, 591 bp, Homo sapiens
  misc_feature: GZ8MTXP01EH5FD.10.71.G05.1.454.CMB.2.raw
  modified_base (203)..(203): a, c, t, g, unknown or other
  misc_feature (203)..(203): n is a, c, g, or t
  modified_base (429)..(429): a, c, t, g, unknown or other
  misc_feature (429)..(429): n is a, c, g, or t
  modified_base (575)..(575): a, c, t, g, unknown or other
  misc_feature (575)..(575): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgttcgctacgttcgttagggtgtatcaacataaatccggcaggctcccaggcctcctcattctttgattcgtctttacaacgtacgggccccctgggccgtccccgaggtctaggtttcaggtggctaggtcgggtctggggactaggtaaccttcaactctaccaccatcaagcagcctagacgctagaagtnttttagcttagtttatactgtcagtcagggtcgtgtccgtacgttcgggcggtaggtcgtaccgtacgtttcgggacgggtaacgggaacctaaaagtggaacggtacaaacgtaacgtggttaggcttgaacctactaattcgtnttcttcttcgttcccg

SEQ ID NO: 304856 - DNA, 581 bp, Homo sapiens
  misc_feature: GZ8MTXP01AGW30.10.71.G05.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctntcctgcagggccagtcagngtgttcgctacttgttaggggtgtatcaacataatccggcaggctcccagctcctcatctttgatgtcctttacaacgcgggcccctgggcctcccgaggtcaggttcgagtggctaggtgggtatggggactaggtaacttcgaactctccgacctatcagctacgcctagacgctagaacgtntttagctagtttatacttgtcagtcagggtcgtcgtcctacgtttcggcggtaggtcgcccgtacgttcgggacgggtacgggaacctaaaagtacgggttaaggtaccgaaagacgtggttcggcttacgccgtactaattctcgttcttccttaacgtttccccg

SEQ ID NO: 304857 - DNA, 640 bp, Homo sapiens
  misc_feature: GZ8MTXP01AG9SS.10.71.G05.1.454.CMB.2.raw
  modified_base (356)..(356): a, c, t, g, unknown or other
  misc_feature (356)..(356): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcgtggtccggccgtgggggtccctgagtactctcctgttctgcgtctggattcatctttagtaatctggctatcgtcctgggtcccgcgtacggttccgacggccgacgggctaggaagtggggtggcagatatacaatanagtatagaacgtaaaagtaaaataataactagtaggtacgtaccttaccttacggaaacgggtccctaacttaccaacctaacttccctaccgaaggaacgaaacctaaacttaacccaaaagtaaccgtagttaggttaggtactacgtagaacctaaagtccgaaccacgtccgaggacgacgaccggaggtaacgtacggttggtttaacttagtggggtaaggttaacgttaacgttccgtaaggttcgctacgtccgttacgttggttaagtttccggg

SEQ ID NO: 304858 - DNA, 696 bp, Homo sapiens
  misc_feature: GZ8MTXP01CGRJN.10.71.G05.1.454.CMB.2.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgttcgctacttcggttagggtgtatcaacataaatccggcaggctcccaggctcctcattctttgatcgtctttcaacgacgggcccctggccgtcccgaggctaggttcaggtggctaggtcgggtctgggacaggtaaccttcaactctccacctntccagcacgtccctagacgtcctaggtaacgtagttttacgactttaaggttttactttacgtcgttacgagtaccgtacggggtcgttacggtccccgttaaccgggtttttccgggggaccggggttaacggggttccggttaccccgttaacgggttttacccgggggacggggtaaaccggggtaaaccctaaaaagggttaacgggttaaacgggtaaccgaaaacggtaaaccgttgggttacggttccgttcggtaaccacccgtaagttctcgttacttccttaacgtttccccg

SEQ ID NO: 304859 - DNA, 714 bp, Homo sapiens
  misc_feature: GZ8MTXP01DLS1E.10.71.G05.1.454.CMB.2.raw
  modified_base (375)..(375): a, c, t, g, unknown or other
  misc_feature (375)..(375): n is a, c, g, or t
  modified_base (455)..(455): a, c, t, g, unknown or other
  misc_feature (455)..(455): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcggtgggggaggcgtggtccgggccgtggggggtccctggagactctcctgttctgcgtctggattcattctttaagtaaatctggcatgtcctgggtccgccgtacggttccaggcccgacggggctaggaactggggtgccagatatacaataatagntgaactaaagtaaaactataactagtaggacgtactaccttacgaagggtccagtttaccacctactcctaccaacgaanaacctaaacgttttaacccaaaagggtaaacctaaagttaggggtaaacgttaattacccgttaagaaaccggtaaaaacttaccgggaaacccaacgggtccccggttaagggaaacggaacggggaccccggggaaaggggttaaacccgggtaaccgggggtttttaaggttttttaacgtttaaaccgttgggggtttaaacggggaaacgttaaaacgtttcccggtttaagggtccgggttaaccttaaccgg

SEQ ID NO: 304860 - DNA, 706 bp, Homo sapiens
  misc_feature: GZ8MTXP01EWFCO.10.71.G05.1.454.CMB.2.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaancgccaccctctcctgcagggccagtcagagtgttcgctacttcggttaggggtgtatcaaacataaatccggcagctcccaggctcctnatctttgatgtctttacaacgcggtcccctgggcctcccgaggctaggttcaggtggctacggtgggtcnggggacagacttcnctctacaccatcagcacgcctaagcgtaccgtaggaaattacgttttaggacctttaaaggtttttaacttacgttcggtactaaacggtcccgtaaggggtccggtttacggcccgttacggtttccgggggacgggtacgggttcggtacccgttaccgggtttcggggaacccggggaaacgggtaaacccgtaaaaaggttacgggaaacgggttaaaccgttaaaaaccgggtaaacgttcggggttaacgggttccgttacgggaaccctaacccggtaactttccgttacggtttcctttaaccggttaaccgttttcccccgg

SEQ ID NO: 304861 - DNA, 648 bp, Homo sapiens
  misc_feature: GZ8MTXP01CK2LK.10.71.G05.1.454.CMB.2.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtggggggaggcgtgggtccggccgtggggggtccctgagactctctgttctgcgtctggattcatctttagtaaatctggcatgtcctggggtccncctaggttccaggcccacggggcctgggaaacttgggggngacgagataataactaatatagatagaactaaaagtaaaataataactagtaggtactaccttaccgttacggaacgggtacctaacttacccaactactaccaccgaagaacaactaactaaccaaagtaactagtagtacggtactacgtacgaacgaaatcgaaccgacgaccgtagacggacggaccgggaagggtaacggtaacgggtttagtttaacgttacgttagggtagggttaacgttaaacttccgttaaggacgtaaccgtacgttccgttaccggtttggttaacgtttcgg

SEQ ID NO: 304862 - DNA, 583 bp, Homo sapiens
  misc_feature: GZ8MTXP01B7O2X.10.71.G05.1.454.CMB.2.raw
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtggggggtccctgagctctcctgttctgcgtctggattctatctttagtaaatctggctatcgtcctgggtcccnctacggttccagggtcccacgggctgggaactggggtgcccaggatatacaataatgaatgaactaagtaaaatntaactatggatacttaccttacgaagggtccaattaccaacctattccaccaagacaactaacttacccgaaaggtaaactatagggtataactccgtagacctaaatcggaacccaagtccaaggacgagcccggagaaccgtagggttgttttacttagtaaggtagggaataactcgttaagtcgaataaccg

SEQ ID NO: 304863 - DNA, 686 bp, Homo sapiens
  misc_feature: GZ8MTXP01BPCHS.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagagtgggtggagtcggtgggggaggtcggtgggtccgggccggtcgggggtccctggacgtctctcctgttctgcgtctggtattcattctttaagtaaatctggctagtcgtccgtgggtcccgccgtacggttccgacgggccgacggggtcgtagggaagtgggggtgaccaaggtataataacaataagtagaacgtagaaactaaagttaaaaattagtaacgtagtacgggtacgtaccgttaccgttacggaaacggggtccctaatttacccaaccctacttaccctaccgaaagtaacgtaaacctaaacgttacccgaaaagtaaacctagtacggttagtactcgtagaaactaaagtccgaaccacgccgtaagggaacgacggcccggttaagggtaaccgttacggggtttagtttacgttacggtggtaggggtaactaaacgtcgttaaggtcggttaacgtaacg

SEQ ID NO: 304864 - DNA, 608 bp, Homo sapiens
  misc_feature: GZ8MTXP01APAJH.10.71.G05.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctcagggaaangccacctntcctgcagggccagtcagagtgtcgcactttcggttagggtgtatcaacataaatccggcaggcctcccaggctcctcattctttgatgtcctttcaacgcggcccctggccgtcccaggcaggttcaggtggcaggtgggtgtcgggacagaacttcaactctcgacntcagcagcctagacgtctagaagtntttgcttaagttttacttacgtgtacgagtcaggggtcgtacgtcctacggtttcgggaccgggtaggttcgtaccgtacggtttccgggacgggtaacggtaaccctaaaaggtacgggaacggttaaccaaaacggtaacgtcggttcgggttccttacggaaccaaccgtaacgttccgttcggttaccttcaacgtttccccg

SEQ ID NO: 304865 - DNA, 707 bp, Homo sapiens
  misc_feature: GZ8MTXP01DN22F.10.71.G05.1.454.CMB.2.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (678)..(678): a, c, t, g, unknown or other
  misc_feature (678)..(678): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaanacgccaccctctcctgcagggccagtcagtagtgttcgctacgttcggttagggtgtatcaactataaacgtccggcaggcctcccgagtcctcctanatctttgatcgtctttacgaaacgtcgggcccctgggccgttccccgaagggtcctaagggtttccaagggtcgggaccgtacgggttcgggggtccgtagggggaacctacggtaaaccctttccaaccgttcctaccaaacctactaccgaacggcaacgtacccttaaggacgtacccgttaaggtaaacgttagtttttacggaaacctttaggttttaacttacgtcgttaacgacgttaccgaacggggtccggttacggtacccgttaacggtttccggggacggtacggtaccggtacccgtacggtttcggggaacgggtaacgggaaacctaaaagtaggacggtaacaaacgtacgtgttacggttnttacgcagtctcgtattctcgttctcccg

SEQ ID NO: 304866 - DNA, 697 bp, Homo sapiens
  misc_feature: GZ8MTXP01BOWWE.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcggtgggggaggtcggtgggtccgggccggtcggggggtccctggacgtctctcctgttctgcgtctggtattcatttcgtttaagtaaatcgtggctagttcggtccgtcgggtcccgaccgtacgggttcccgagggcccgacggggtctagggaagtggggtcggaccaggtaattataacgtaattaagtagaatagaaactaaagttaaaatattaacgtagtacggtactaccttaccgttacgaaacggggtccctaatttacccgaaacctacttccgtaaccgaagaactaaacctaaacctttaacggaaaacgtaaaccgtagttagggttactaagttactacggtaaacaaaacgtcgaaacctacgcccgtaaggaacggacggtaccggaacgggtaaccgttggggtttagtttacgttacgtaagggtaaggaacgttaaactccgttaaggtcgaacgtaacg

SEQ ID NO: 304867 - DNA, 679 bp, Homo sapiens
  misc_feature: GZ8MTXP01D9ADN.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagtcttgggttttcctcgttgcttcttttaagagtatgtccagtgtcagatgcagatgggtggagtcgtgggggaggcggtgggtccggcgtgggggtccctgagactctctgtctgcgtctggattcattctttaagtaatctggtctatcggtccgtcgggtcccgccgtacggttccgacggtcccgtacgggggtctagggaagttcgggtggacaggtaactatacaaagtatagaaactagaactaaagtaaaattataactagtacgggaaacgtaccttcccgttagaaacgggtcctaattaccaactatctaccaggtaacaaacctaattaacaagtaactaggttgtaagttactcgttagaacctaaagtaccgaacccgagtaccctagggaacggaaacggtcccgggttaagggtacccgttaaggggtttacttttaacgttaacgggttggggttaaggggaaaccttaagttcccgtaagggttcggttacctaacgttcccgtttaaaggg

SEQ ID NO: 304868 - DNA, 640 bp, Homo sapiens
  misc_feature: GZ8MTXP01AEZC9.10.71.G05.1.454.CMB.2.raw
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
  modified_base (501)..(501): a, c, t, g, unknown or other
  misc_feature (501)..(501): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttacttttaagagtatgtccagtgtcagatgcagatgggtggagtcgtgggggagtcggtgggtccggccgtgggggtccctgacgctctcctgttcngcgtctggattcattctttaagtaaatcgtgctagtcggtccgtcggggtccnccgtagggttccagggcccgacggggcttagggaacgtggggtcgaccaggactagtaacaataagtgaatagaactaagtaaaatntaactagtgactactaccttacgaacgggtctattaccacctataccacaaggaactaactaaacgtacccaaagtaaccgtagtacggttnttaaactccgttaggaacctaaagtccgaaacccgtagtcccgaagaaggttacggcccggttaaggaccgtaacgggtttacgtttagttacgggtaaggtagggaacgttaaacgtccggttaagtcggccttaacg

SEQ ID NO: 304869 - DNA, 728 bp, Homo sapiens
  misc_feature: GZ8MTXP01AIING.10.71.G05.1.454.CMB.2.raw
  modified_base (325)..(325): a, c, t, g, unknown or other
  misc_feature (325)..(325): n is a, c, g, or t
tcagcatagtagtgcacgaccggtgctcgatttagtgtcgtcgcaagagagaggggagctctgggagaggagcccagcactagaagtcggcggtgtttccattcggtgatcagcactgaacacagaggactcaccatggagttttggctgagcttgggttttccttgttgctatttcaaaaggtgtccactgtgaggttcaactggtgagacgtggaggaggctggactccgagtccgtgggggtccctgacgactctcctgtcgcagcctcgtgggttcacgcattcgaagtaaccgactaacatcgacccgtcggggaccccnccggaacggtccgtacccgggaagggggaacgggggtccgtagggggacggttcggggtcttaccggtaacgtttaacgtaggaaaacctagacgttaggacctaacgtacaaatttatttacgttccgtacgtaccgttacccgagggtaaaccggggtccccgtttcccaacccttcgttaccgaaacggtacaccccttaacgttccccaaaactaacggtactttcccggttagtaactttccgttaacaacccgttaatccgaacctaacgttaacttcggtaggaacgtaaccggtacccggaaccgtaacgttacccgtaaccttagtttaacgtttagttccggttacgacggtaaccattaaccgtacgtacccgttactaaccgttaacgtcg

SEQ ID NO: 304870 - DNA, 681 bp, Homo sapiens
  misc_feature: GZ8MTXP01DT8UP.10.71.G05.1.454.CMB.2.raw
  modified_base (299)..(299): a, c, t, g, unknown or other
  misc_feature (299)..(299): n is a, c, g, or t
  modified_base (656)..(656): a, c, t, g, unknown or other
  misc_feature (656)..(656): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagttgggctgagcttgggttttcctcgttgcttacttttaagagatgtccagtgtcagatgcagagtggtggagtcggtgggggagcgtggtccggccgtgggggtcctgagtctctctgtctgctctggtatctatcttaagtaactctgcatcgtccgtcgggtccnccgtacggttccgaacggccccgtaacggggtcgtagggtaacgtgggggtaggactaagtaataagtaaactaaacgtatagaagtacgaaactaaaaagttaaaaaattgtaaaccgttaagtaacgggtaaacgtacctttacccgttaacgaaaccgggggtccttaacttaccaacctaacgtacctaaccgaaagacgtaaacctaaacttacccgaaaaagtaacgtagttaccgggtagttaacttaccgtaggaactaaaagtcgaccagttaccagaacgacggcccggaaggtaaccgtgggtttagttattacgtggtaacgggaaattaacgttcaagggtcgntactacgttacgtgttaagttcggg

SEQ ID NO: 304871 - DNA, 530 bp, Homo sapiens
  misc_feature: GZ8MTXP02JIVDI.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtgtatcaacataaatccggcaggctcccaggctcctcatctttgatgtctttcaacacgggcccctggccgtcccaggcaggttcagtggcaggtgggtctgggacagacttcactctcaccatcagcagcctagacgcctagaagtattttgctagtttatactgtcagtcagcgtgacctacgtttcggcggtaggtcgcctacgtttcggcgggtaagggaacctaaaagtagaggtacgaaacgacgtgtcggctgcgacatctgtcttcattcc

SEQ ID NO: 304872 - DNA, 541 bp, Homo sapiens
  misc_feature: GZ8MTXP02I1QDL.10.71.G05.1.454.CMB.2.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggcaggctcccaggctcctcatctttgatgctttcaacagggcccctggcgtcccaggcaggttcagtggcaggtgggtctgggacagacttcactctcacatccagcagcctagagcctgaagtattttgctagtttattactgtacagcagcgtgcctacgtttcgggcggtaggtcgcctacgtttcgggcggaagggtaccaaaagtacggaaggtacaaaacggaactacgtaggctagacaaccgtatcctagtcttcactcctttcccg

SEQ ID NO: 304873 - DNA, 509 bp, Homo sapiens
  misc_feature: GZ8MTXP02JXTNR.10.71.G05.1.454.CMB.2.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcgtcgcaagagagaggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctctcctgcagggccagtcagagtgttcgcacttcgttagggtgtatcaacataaatccggcaggctcccaggctcctcatctttgatgctttcaacaggcccctggcgtcccaggcaggttcagtggcagtgggtctggggacagacttcnctctcaccatcagcagcctagagcctgaagatttgctagtttatactgtcagcagcgtgcctacgtttcggcggaggtgccgtacgtttcggcggtagggaaccaaaagtagaggtacaaacgactagtgctgcacatctgtctcattcc

SEQ ID NO: 304874 - DNA, 541 bp, Homo sapiens
  misc_feature: GZ8MTXP02GH9E9.10.71.G05.1.454.CMB.2.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgctacttcggttaggggtgtatcaacataatccggcaggctcccaggctcctcatctttgatgtctttcaacncgggcccctggccgtcccaggctaggttcaggtggcaggtgggtctggggacagtacttcnctctcaccatcagcagcctagacgcctagaagtattttgctagtttattactgtcagcagcgtgcctacgtttcggcggtaggtcgccgtacgtttcgggacgggtacgggaaccaaaagtacggaggtacgaaaacgaacgtgtcggctagcaccatctgtcttcacttccc

SEQ ID NO: 304875 - DNA, 541 bp, Homo sapiens
  misc_feature: GZ8MTXP02JF1U2.10.71.G05.1.454.CMB.2.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccagggggaaanagcccaccctctcctgcagggccagtcagagtgttcgcacttcggttaggggtgtatcaacataaatccggcaggctcccaggctcctcatctttgatgctttcaacncgggcccctggccgtcccaggcaggttcagtggcaggtgggtatgggacagacttcnctctcaccatcagcagcctagacgcctagaagtattttgctagtttattactgtcagcagcgtgcctacgtttcgggcggtaggtcgcctacgtttcgggacgggaacgggaacctaaaagtacggaaggtacaaaacgaactgtcggctgcgaccatactgtcttcactccg

SEQ ID NO: 304876 - DNA, 525 bp, Homo sapiens
  misc_feature: GZ8MTXP02IVSWZ.10.71.G05.1.454.CMB.2.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctctcctgcagggccagtcagagtgttcgcacttcgtagggtggtatcaacataatccggcaggctcccaggctcctcatctttgatgctttcaacagggcccctggccgtcccaggcaggttcagtggcagtggtctgggacagacttcnctctcaccatcagcagcctagacgcctagaagtattttgctagtttattactgtcagcagcgtgccctacgtttcggcggtagggtcgccgtacgtttcgggacggaggggacccaaaagtgaagggtacaaacgaactggtacgctgcacatctgtcttcattcc

SEQ ID NO: 304877 - DNA, 594 bp, Homo sapiens
  misc_feature: GZ8MTXP02G1VA0.10.71.G05.1.454.CMB.2.raw
  modified_base (352)..(352): a, c, t, g, unknown or other
  misc_feature (352)..(352): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcatcttagtaatctggcatgtcctgggtccgccaggttccaggccgacggggctggaagtggggtggccagatatacatangatgaacagtaaatatactataggagtacttcccgttacgaacggggtcctaattccaaccctattccgtacccaagaacgaacctaaatttacccaaaaggtaaccagttcgggtagtactaccgttaggactaaaatcgaacccgagtccctggaacgacggacccggaagggacccgtaggggttacgtttacgttacggtgggtagggaagtaaaactccgtaggttacggactaacg

SEQ ID NO: 304878 - DNA, 526 bp, Homo sapiens
  misc_feature: GZ8MTXP02IB0XU.10.71.G05.1.454.CMB.2.raw
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatcttagtaaatctggcatgtccccgggtcgccaggttccaggcccacgggctggaatggggtggcagatatacaatatgatgaacagtaaaatatactataggagactccttcgaaaggccgattcaccatctccagagacaattaccaagacatggtgtatctgacaaatgaccagcctagagagccgagaccgacgggttgtttataactggtagggaagaacgttacctagtggcagtcaccgtggtactttggtacgg

SEQ ID NO: 304879 - DNA, 526 bp, Homo sapiens
  misc_feature: GZ8MTXP02HIFC3.10.71.G05.1.454.CMB.2.raw
  modified_base (304)..(304): a, c, t, g, unknown or other
  misc_feature (304)..(304): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagactctcctgttctgcgtctggattcatctttagtaaatctggcatgtcctgggtccncaggttccaggccacgggctggatgggtgccagatatacaatatgatgacaagtaaaatatactatggaagactcttacaagggccattcaccatctaccagacgacaaattccaaagtaacatggtatatctagacaaaatgaaccagcctagagagccgaaggacctacgggttgtttaatacgtggttagggaagtaaaactccgtagtcggactaacg

SEQ ID NO: 304880 - DNA, 503 bp, Homo sapiens
  misc_feature: GZ8MTXP02FVC53.10.71.G05.1.454.CMB.2.raw
  modified_base (356)..(356): a, c, t, g, unknown or other
  misc_feature (356)..(356): n is a, c, g, or t
  modified_base (458)..(458): a, c, t, g, unknown or other
  misc_feature (458)..(458): n is a, c, g, or t
tcagcatagtagtgcacgaccggtgctcgatttagtgtcgtcgcaagagagagggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatcttagtaaatctggcatgtcctgggtccgccaggttccaggccacgggctgggatggggtgcagatataccaatatgatgacagtaantactatgagactctcaaggcattcacatctccagagacaataccaagaaacatggtgtatctagacaaaatgaccagcctgagagccgaaggacacggggtntttagtactgtaggagaaatccgtagtggacatcacctggttaag

SEQ ID NO: 304881 - DNA, 533 bp, Homo sapiens
  misc_feature: GZ8MTXP02G6601.10.71.G05.1.454.CMB.2.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttaggggtgtatcaacataaatccggcaggctcccaggctcctcatctttgatgtctttcaacgacgggcccctggccgtcccaggcaggttcaggtggcaggtgggtctggggacagacttcnctctcaccatccagcagcctagacgcctagaatatttgctagtttatactgtcagcagcgtgcctacgtttcggcgtaggtcgccgtacgttcggacggaagggaaccaaaagtagaggtacaaacgacgtgtacgctgaacacagtctagtcttcacttcccg

SEQ ID NO: 304882 - DNA, 503 bp, Homo sapiens
  misc_feature: GZ8MTXP02IHA6G.10.71.G05.1.454.CMB.2.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagcatagtagtgcacgaccggtgctcgatttagtgtcgtcgcaagagagaggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccacctctcctgcagggccagtcagagtgttcgcactttcgttagggtggtatcaacataaatccggcaggctcccaggctcctcatctttgatgctttcaacncggcccctggctcccaggcaggttcagtggcagtggtctgggacngacttcactctcaccatccagcagcctagagcctgaagtattttgctagtttatactgtcagcagcgtgcctatttcggcgagtgcctacgttcggcgaggaccaaaagtgaggtcaaaacgaactgtaggctgctacatctgtctcattcc

SEQ ID NO: 304883 - DNA, 524 bp, Homo sapiens
  misc_feature: GZ8MTXP02JDV17.10.71.G05.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaangccaccctntcctgcagggccagtcagagtgttcgcacttcgttagggtgtatcaacataaatcgcaggctccaggctctcatctttgatgctttcacnggcccctggctcccaggcaggtcagtggcaggtggtctgggacaggacttcnctcncaccatcagcagcctagagcctgaagtatttgctagtttattactgtctagcagcgtgcctacgtttcggcggtaggtcgccgtacgtttcggacggtacgggaacctaaaagtaggaacggtacaaacgtaacgtgtacggctgcgacgactctgtctcacttcccg

SEQ ID NO: 304884 - DNA, 565 bp, Homo sapiens
  misc_feature: GZ8MTXP02H1ZI2.10.71.G05.1.454.CMB.2.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagcatagtagtgcacgaccggtgctcgatttagtgtcgtcgcaagagagaggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctctcctgcagggccagtcagagtgttcgcacttcgtagggtgtatcaacataaatccggcaggctcccaggctcctcatctttgatgctttcaacngggcccctggcgtcccaggcaggttcagtggcagtggtctgggacagacttcnctctcaccatcagcagcctagagcctgaagtattttgctagtttatactgtcagcagcgttgcctacgtttcggcggtaggtcgcctacgtttcggcgggaacgggaacctaaaaagtacggaagggttacgaaaaacggaaacgttggtacggtccgttaggaaccgtaaccgtaacgttccttacggttcctttcaactttccccg

SEQ ID NO: 304885 - DNA, 578 bp, Homo sapiens
  misc_feature: GZ8MTXP02GBF8V.10.71.G05.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttaggggtgtatcaacataaatccggcaggctcccaggctcctnatctttgatgctttcaacgaggcccctgggcctcccaggcaggttcaggtggcaggtgggtctggggacagtaccttcnctctcacatcagcacgcctagacgctagaagtattttgcttaagtttatacgtgtcagcagcgtcgcctacgtttcgggacggtaggtcgccgtacgtttcgggacgggtaacgggaacctaaaagtacggaaggtaaccgaaaacggtaacgttaggtacggtcgtacggaaccgaccgtactaccgttgttaccttactactttcccg

SEQ ID NO: 304886 - DNA, 654 bp, Homo sapiens
  misc_feature: GZ8MTXP02F28E3.10.71.G05.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgcctccaggggaaangccaccctctcctgacgacgggccagtcagtagttgttcgctacgttcggttagggtgtanacaanataaacgtccggcaggcctccgagcctccncattctttgatcgtctttacaacgccggtcccctggccgtcccgaggccgtaggttcaggtcggctagggttcgggtcgtagggacacgtaccttcaccgttccaccaacctatcgaacgccacgtacctagacgtccgtaagaacgtttagttttacgacgtttaagttttaacttaccgtagtaccgtagaccgtaaggtccgtccgtacccgttaccggtttccggggacgggtacggtcgacccgttacggtttccggggaacgggaacgggaaaacctaaaacggtaggtaacggtaacaaaacggtaactggtacgctagaactacgtactcgtagtctactacttcccg

SEQ ID NO: 304887 - DNA, 565 bp, Homo sapiens
  misc_feature: GZ8MTXP02GSR2P.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaanagccaccctctcctgcagggccagtcagagtgttcgctacttcggttaggggtgtatcaacataaatccggcaggctcccaggctcctcatctttgatgtctttcaacacgggcccctggccgtcccgaggcaggttcagtggcaggtgggtctgggacaggacttcactctcaccatcagcagcctagacgcctagaatattttgacttagtttattactgtacagtcagcgtgaccctacgtttcgggacggtaggtcgtccgtacgtttcgggacgggaagggaaccaaaacgtaggaacggtacaaaacggtacgtacggtaggactgaaccaccgactcgtcgtcttactacttcccg

SEQ ID NO: 304888 - DNA, 557 bp, Homo sapiens
  misc_feature: GZ8MTXP02FUYCP.10.71.G05.1.454.CMB.2.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggcaggctcccaggctcctcatctttgatgctttcaacacgggcccctggccgtcccaggcaggttcagtggcagtgggtctggggacagacttcnctctcaccatcagcagcctagagcctgaagtattttgctagtttattactgtcagcagcgtgcctacgtttcggcggtaggtcgcccgtacgtttcggacgggtaacggaaccgtaaaagtaggaaggtacaaaacggaacgttaggtacggctcggaacgtaccctattactcgttcttaccgtactttcccg

SEQ ID NO: 304889 - DNA, 571 bp, Homo sapiens
  misc_feature: GZ8MTXP02HW9HR.10.71.G05.1.454.CMB.2.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagagtgttcgcattcggttaggggngtatcaacataaatccggccaggctcccaggctcctcatctttgatgtctttacaacagggcccctggccgtcccaggcagggttcagtggcaggtgggtctggggacaggtaccttcactctcaccatcagcagcctagagcctagaatattttgctagtttattactgtacagtcagtcgtcgacctacgtttcggcggtaggttcgcccgtacgtttcgggacgggaagggaaaccctaaaagtacggaaggtaactaaaacggactaggtacggtctaggaaccgacctattctacgttccttactacttccccg

SEQ ID NO: 304890 - DNA, 610 bp, Homo sapiens
  misc_feature: GZ8MTXP02G25PG.10.71.G05.1.454.CMB.2.raw
  modified_base (203)..(203): a, c, t, g, unknown or other
  misc_feature (203)..(203): n is a, c, g, or t
  modified_base (453)..(453): a, c, t, g, unknown or other
  misc_feature (453)..(453): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttaggggtgtatcaacataaatccggcagctcccaggctcctcatctttgatgtctttacaacgacggggcccctgggccgtcccgaggcaggttcaggtggcaggtgggtctgggacagtaccttcactctcacctatcagcagcctagacgcctagaagtatttgctagtttatactgtcagtcagcgtagcctagtttcgggnggtaggtcgtcccgtacgtttcggggacgggtaaaggggaaaccctaaaaaggttacgggaacggttaaccgaaaaacgggtaacgttgggtacgggtaccttacggaacccgtacccgtaattccgttacgtttacctttcctaacgtttcccccg

SEQ ID NO: 304891 - DNA, 526 bp, Homo sapiens
  misc_feature: GZ8MTXP02IHBM2.10.71.G05.1.454.CMB.2.raw
  modified_base (302)..(302): a, c, t, g, unknown or other
  misc_feature (302)..(302): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagactctcctgttctgcgtctggattcatcttagtaatctggcatgtcctgggtccncaggttccaggccacgggctggaatgggtgccagatatacaatatgatgacaagtaaaatatactatggagtactccttacaaggggtccgatttcaccctatcctaccagagacaaattccaaagaacatggtagtatctgcaaatgaccagcctagagagccgaggacacgggttagtttattaacgtggtagggaagtaaactccgtagttacggactacg

SEQ ID NO: 304892 - DNA, 532 bp, Homo sapiens
  misc_feature: GZ8MTXP02HGID6.10.71.G05.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatcttagtaaatctggcatgtcctgggtccncaggttccaggccacgggctggatggggtgccagatatacatangatgacaagtaaaatataactatggagactccttacgaaggggccattcaccatctaccagagacaattaccaaagaacatgggtataactctagactaaaatgaaccagcctagagacgccgaaggacgtacgggttatttattacgtggtagggaagtaaaacgtccgtaagtcggactacg

SEQ ID NO: 304893 - DNA, 542 bp, Homo sapiens
  misc_feature: GZ8MTXP02H8F85.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcatcttagtaaatctggcatgtcctgggtccgccaggttccaggccacgggctggaatggggtgcagatatacaatatgatgacaagtaaaatataactatggagtactccttagaagggccattcacctatcctcagagacaattccaaagaacagttggtatatctagactaaatcgaccagcctagacgacgccggaaggaccgaggggttactttaagtacgttgggagggtaaagtaactaccgtaggtaggcctaagttacctaacgg

SEQ ID NO: 304894 - DNA, 525 bp, Homo sapiens
  misc_feature: GZ8MTXP02GG6XI.10.71.G05.1.454.CMB.2.raw
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagcatagtagtgcacgaccggtgctcgatttagtgtcgtcgcaagagagaggggggagaggagcccagcactagaagtcggcggtgcctccattcggtgatcagcactgaacacagaggactcaccatggagtttgggctgagcgtggtttcctcgttgctctttaagagatgtccagtgtcagatgcagatggtggagtctgggggaggcgtggtccggcgtgggggtccctgagactctcctgttctgcgtctggattcatcttagtgaatctggcatgtcctgggtccgccaggttcccaggcccacgggctggaagtgggtgcgagatatanaatatgataganagtaaataataatatagagatcttcagacgactacacatactcacgaanacactacaaanaacagtagtagtatatanacaanacgacacgacgagagacgacgacggacgtacggtagttacgttacgtacgtaggaagtaacgtacgtacgtacgtacgtactactacgtacg

SEQ ID NO: 304895 - DNA, 531 bp, Homo sapiens
  misc_feature: GZ8MTXP02JAR0H.10.71.G05.1.454.CMB.2.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttagtaaatctggcatgtcctgggtccgccaggttccaggcccacgggctggaatggggtgccagatatacaatangatgaacagtaaaatntactatggagactccttcaagggccgattacaccatctccagagacaattccaaagaacatgtagtatctagacaaatgaccagaccctagacgagccggaaggacgtacgggttgttaattacgtggttagggagtaaacgtccgtagtcggactaacg

SEQ ID NO: 304896 - DNA, 527 bp, Homo sapiens
  misc_feature: GZ8MTXP02FZP0W.10.71.G05.1.454.CMB.2.raw
  modified_base (211)..(211): a, c, t, g, unknown or other
  misc_feature (211)..(211): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcgtcgcaagagagaggaggcgtggtccggcctggggggtccctgagactctcctgttctgcgtctggattcatctttagtaatctggcatgtcctgggtccgccaggttccaggccacgggctggaatgggtggcagatatacaatatgatgacagtaaaatatactatgganactccttcaagggccattcaccatctccagagacaattccaagaacatggtgtatctgcaaatgaccagcctgagagccgaggacacgggtgtttattactgtggganaaatcctagnggcatccacctggtattgtgacttcggggccagggaaccgtggcaccgtctcttcggccctccaccaagggccatccgtctcccctggcgccctnctccaggacgcacctccgagacncacagtccggccctggggctcgcctcgggtcaaacggactacctcccactacctntagctgacgcgggctggacgacgcg

SEQ ID NO: 304897 - DNA, 506 bp, Homo sapiens
  misc_feature: GZ8MTXP02IQYO0.10.71.G05.1.454.CMB.2.raw
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (472)..(472): a, c, t, g, unknown or other
  misc_feature (472)..(472): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattcttagtaatctggcatgtcctgggtccncaggttccaggccagggctggatgggtgccagatanacaatatgntgacagtaaaatntactatganctctgaaggcgattcacctatctaccagagacaattccaaagaacagtggtagtatctagacaaaatgaccagcctagacgagaccgaggactacgggtntttatacgtgaggacaactcgtagtcggactacg

SEQ ID NO: 304898 - DNA, 558 bp, Homo sapiens
  misc_feature: GZ8MTXP02HQLKA.10.71.G05.1.454.CMB.2.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccacctctcctgcagggccagtcagagtgttcgctactttcggtagggtgtatcaacataanccggcaggctccagctcctcatctttgatgtctttcaacgcgggcccctggccgtcccaggcaggttcaggtggcaggtgggtctggggaccaggtaccttcnctctcaccatcagcacgcctagcgcctagaagtatttgacttagtttatactgtcagtcagtcgtgcctacgtttcgggcggtagtcgaccgtacgtttcgggacgggtaacgggaacctaaaaggtagaacggtacaaaacggtaactggtacgctgaacctactacgtctagttcctactacttcccg

SEQ ID NO: 304899 - DNA, 571 bp, Homo sapiens
  misc_feature: GZ8MTXP02GJUMT.10.71.G05.1.454.CMB.2.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaagacgccaccctctcctgcagggccagtcagagtgttcgctacttcggttagggtgtatcaacataaatccggcaggctcccaggctcctcatctttgatgtctttacaacgcggcccctggccgtcccgaggctaggttcagtggcaggtgggtctggggacagtacttcactctacaccatcagcagcctagacgctagaagtatttgactagtttatacgtgtcagcagtcgtcgccgtacgtttcggacggtaggtacgccgtacggtttcgggacggggaacggaaccgtaaaagtacggaaggtacaaaacggtacgtggtacggtcgtcgaacgtaccactcgtcgttacctctacttcccg

SEQ ID NO: 304900 - DNA, 511 bp, Homo sapiens
  misc_feature: GZ8MTXP02GCW4L.10.71.G05.1.454.CMB.2.raw
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcgtggtttcgcgtagctctttaagagatgtccagtgtcagatgcagatggtggagtcgtgggggagcgtggtccggcgtgggggtcctgagctctctgttctgcgtctggattcatcttagtaaatctgcatgtctggtccncaggttccaggccacgggctggaatgggtgcagatatacatatgatgacagtaaatatactatgganactctanaaggccattcactatctacaganacaattaccaagaacatagtgtatactagacanacgacacgacgagagacgacgacgacgtacggttacgttacgtacgtaggtaggtaagtaacgtacgtacgtagtacgtactacgtacg

SEQ ID NO: 304901 - DNA, 539 bp, Homo sapiens
  misc_feature: GZ8MTXP02HI7HX.10.71.G05.1.454.CMB.2.raw
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcggtggtccggcgtgggggtccctgagactctcctgttctgcgtctggattctatctttaagtaaatctggcatgtcctgggtccgccaggttcccaggcccaacggggctagggaagtgggnggcagataanaccaaatntgatacganaaagtaaatataatatggaatactccttagaaagggccattcacatctacaganaacataccaagaanangtgtatanananaanacacacacagagacgacgacgacgtacgttagttagttacgtagtaggaagtaacgtaacgtagtacgacactacgtacgtacgtag

SEQ ID NO: 304902 - DNA, 579 bp, Homo sapiens
  misc_feature: GZ8MTXP02HF82P.10.71.G05.1.454.CMB.2.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaanagccacctctcctgcagggccagtcagagtgttcgcacttcggttaggggtgtatcaacataaatccggcaggctccaggctcctcatctttgatgtctttcaacgacgggcccctggccgtcccaggcaggttcaggtggcaggtgggtctggggacagacttcnctctcaccatcagctacgcctagacgcctaggaacgtattttgactagtttatactgtacagctagcgtgcctacgtttcggcggtaggtcgccgtacgtttcgggacgggaacgggaacctaaaagtacggacggtacaaaacggtacgtacggtacggccgttaggaaccgtaacgacttccgtacgttccttacgtaactttcccccg

SEQ ID NO: 304903 - DNA, 911 bp, Homo sapiens
  misc_feature: GZ8MTXP02GRK2Q.10.71.G05.1.454.CMB.2.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtccctgagctctcctgttctgcgtctggattcattctttagtaaatcgtggctattcggtcccgtggggtccccgtccgtacggtttccccgacgggccccgaacggggtctacggggtaagttcgggggtaggaccgaaggtaacttaactaaacccgtaaaatttagtagtaagttaacggaaaaccgttaaaaggttaaaattaattaaaccgttaaagttacggggtaaacgtacccgtttacccgtttaaccggaaaacgggggtccctaaactttacccaaacccgtaactttacccgtaacccgtaaacggaaaccgtaaaaccgttaaaaacctttaaacccccgaaaaaggtaaaaacccgttaacggtttaagggggttacggttttaaaaccttccggttaacgggtaaacctaaaaaaacgtttccgggtaaaaccccgaacggtaccccgtttaagggaaccggggaaaccgggtaacccccggggtaaaggggtaaaaccccggtttaacggggggttttaacgtttttaaacggtttaacccgggtttaagggggtaaccgggggtaaaagtttaaaaccgttccccgggtttaaaagggttcggggtaacccttaaccgttaacccggttaacccggtttagggtttttaaaccgggg

SEQ ID NO: 304904 - DNA, 584 bp, Homo sapiens
  misc_feature: GZ8MTXP02JZ0CN.10.71.G05.1.454.CMB.2.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcggttagggtgtatcaacataaatccggcaggctcccaggctccncatctttgatgctttcaacagggcccctggccgtcccaggcaggttcaggtggcacggtggggtctggggacaggtacttcactctacaccatcagcagcctagacgcctagaagtatttgctagtttactactgtcagcagcgtagcctacgtttcgggcgtagggtcgaccgtacgtttcgggacgggtaaggggtaaaccaaaagttacggaacggtaaccgaaaacggaacgttacggtacgggaccttaggaacctaaccgtaacgttcccttagttcctttacactttcccg

SEQ ID NO: 304905 - DNA, 537 bp, Homo sapiens
  misc_feature: GZ8MTXP02GNGCW.10.71.G05.1.454.CMB.2.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtgtatcaacataaatccggcaggctcccaggctcctcatctttgatgtctttcaacacgggcccctggccgtcccaggcaggttcaggtggcaggtgggtctgggacagacttcnctctcaccatcagcagcctagacgcctagaagtattttgcttagtttattactgtcagcagcgttgcctacgttcggcggtaggtcgccgtacgttcggacggagggaaccaaaagtacggaggtacaaaacgactgtacgctgaacacgactctgtcttactacttcccg

SEQ ID NO: 304906 - DNA, 533 bp, Homo sapiens
  misc_feature: GZ8MTXP02IFGIU.10.71.G05.1.454.CMB.2.raw
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
  modified_base (473)..(473): a, c, t, g, unknown or other
  misc_feature (473)..(473): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcattctttagtaaatctggcatgtcctgggtccgccaggttccaggcccacgggctggaatgggtgcagatatacaatatgatgaacaagtaaaatatactangganactctanaaagggccatcacatctcaganacaatcaaagacatgtnatctgacaaatcgacagcctagagacgccgaaggacgacggggttatttaattacnggtacggggaagtaaaactccgtaaaggtggactataccctaaccttggtaacgtttcgg

SEQ ID NO: 304907 - DNA, 529 bp, Homo sapiens
  misc_feature: GZ8MTXP02GNG9F.10.71.G05.1.454.CMB.2.raw
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcgtcgcaagagagaggggggagaggagcccagcactagaagtcggcggtgcctccattcggtgatcagcactgaacacagaggactcaccatggagtttgggctgagcgtgggttttcctcgttgcttcttttaagagatgtccagtgtcagatgcagatggtggagtcgtgggggaggcgtggtccggccgtgggggtccctgagactctcctgttctgcgtctggattcatctttagtaaatctggcatgtcctgggtccgccaggttccaggccacgggctgggaatggggtgcagatatacaatatgatgacagtaaatataactatgagactccttacgaaggggccaattcaaccatctaccaganaacaattccaaagaacatggtntanctagcaaatgaccngccngagagccggaagaccgagggttntttaattacgtggtagggagaaattccgtagtggacaatcaacctgggtttaa

SEQ ID NO: 304908 - DNA, 544 bp, Homo sapiens
  misc_feature: GZ8MTXP02JZCMB.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaaatctggcatgtcctggtcccgcaggttccaggccacgggctggaagtggggtggccagatatacaatatgatgaacagtaaaatataactatggagactccttacgaagggccgattcaccatctccagagacaacttccaaagaacagtggtagtatcgtagactaaatgaacctagcctagagacgccggaaaggacgtacgggttacgtttagtacgtaagggtagggaagtaaacgtcgtacggttaggcctaag

SEQ ID NO: 304909 - DNA, 550 bp, Homo sapiens
  misc_feature: GZ8MTXP02GEO4Z.10.71.G05.1.454.CMB.2.raw
  modified_base (474)..(474): a, c, t, g, unknown or other
  misc_feature (474)..(474): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcatcttagtaaatctggcatgtcctggtccaccaggttccaggccacgggctgggaatgggtgcagatataccaatatgatgaacagtaatatactatgagactcttcgaaggccattcacatctaccagacgaacattaccaaagaaactagtggtagtatcgtagacaaatcgaccagtcctgagacgccgaaggacctaggggttntttaacgttacgtggtacgggaagtaaaacgttccgtaaaggtcggtacagttacccgtaacgttacggtttaacg

SEQ ID NO: 304910 - DNA, 593 bp, Homo sapiens
  misc_feature: GZ8MTXP02JQMQ6.10.71.G05.1.454.CMB.2.raw
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (470)..(470): a, c, t, g, unknown or other
  misc_feature (470)..(470): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtgggtccggcctggggggtccctgagactctcctgttctgcgtctggattcatcttagtaaatctggcatgtcctgggtccnccaggttccaggccacggggccgtaggtaggtgggtcgacgagtatanaactaatagtagtatagaactaaagtaaatactactagtacggactaccttccgtaagacgggactacttaccacctattccacgaagacaaactactaacgaaacaataggtggtatacttcganaactaagacgacacgtcagacggcgacggacggtaaccggtaggggtttatttaacgtaggtacgggtaacggaagtaaccgtcgtaaggcgactacgtaccgtacgttaggttactttcggg

SEQ ID NO: 304911 - DNA, 516 bp, Homo sapiens
  misc_feature: GZ8MTXP02HHYZO.10.71.G05.1.454.CMB.2.raw
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtgggtttcctcgttgctcttttaagagatgtccagtgtcagatgcagatggtggagtctgggggagcgtggtccggcctgggggtccctgagactctcctgttctgcgtctggatttcatctttagtaaatctggcatgtcctgggtccgcaggttccagggccacgggctggaatggggtgccagatatacaatatgntganagtaaatatanatgagatctcaggcgattcaccanctcacagacaattacacaacatagtagtatntanacaananacacgactacgagagacgacggacgtacggtacgttagttacgtaaggtaggtaacgtaacgtacgtacgtacggtacgtacg

SEQ ID NO: 304912 - DNA, 556 bp, Homo sapiens
  misc_feature: GZ8MTXP02JD8Z0.10.71.G05.1.454.CMB.2.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctntcctgcagggccagtcagagtgttcgcacttcgttaggggtgtatcaacataaatccggcaggctcccaggctcctcatctttgatgctttcaacnggcccctggccgtcccaggctaggttcagtggcagtgggtctggggacngacttcnctctcaccatcagcagcctagagcctgaagtatttgctagtttattactgtcagcagcgtgcctacgtttcggcggtaggtcgtccgtacgtttcgggacgggtacgggaacctaaaagtaggacggtacaaaacggaacgtggtacggtcgtacggaacctaccgtaactccgtgttaccttcactttccc

SEQ ID NO: 304913 - DNA, 553 bp, Homo sapiens
  misc_feature: GZ8MTXP02JQSHR.10.71.G05.1.454.CMB.2.raw
  modified_base (202)..(202): a, c, t, g, unknown or other
  misc_feature (202)..(202): n is a, c, g, or t
  modified_base (350)..(350): a, c, t, g, unknown or other
  misc_feature (350)..(350): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttaggggtgtatcaacataaatccggcaggctcccaggctcctcatctttgatgctttcacaggcccctggctcccaggcaggttcagtgcagtggtctgggacngacttcactctcaccatcagcagccctagacgtcctgtaacgtattttagcctaaggttttaattacttgttacaagtcagcgttgcctacgtttcggcggtaggtcgccgtacgtttcgggacggagggaaccaaaagtaggaggtacaaaacggtaactcggtacggctaggcaccgtatcgtgtacctttcactttcccg

SEQ ID NO: 304914 - DNA, 568 bp, Homo sapiens
  misc_feature: GZ8MTXP02JYNVF.10.71.G05.1.454.CMB.2.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggcaggctccaggctcctcatctttgatgtctttcaacgcggcccctggccgtcccaggcaggttcagtggcaggtgggtctggggacaggtaccttcgctctcaccatcagcagcctagacgcctagaagtntttgcttagtttatactgtcagcagcgtgcctacgttcggcggtaggtcgcccgtacgtttccgggacgggaacgggaaacctaaaaggtacggaacggtacgaaaacggtacgtggtacggctacggaacctaaccgtatccgttgtaccttacacgtttccccg

SEQ ID NO: 304915 - DNA, 679 bp, Homo sapiens
  misc_feature: GZ8MTXP02HBJBB.10.71.G05.1.454.CMB.2.raw
  modified_base (257)..(257): a, c, t, g, unknown or other
  misc_feature (257)..(257): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtggtttcctcgtgctctttaagagatgtccagtgtcagatgcagatggtggagtcgtgggggagcgtggtccggcgtgggggtccctggagctctcctgttcngcgtctggattctattctttaagtaaatcgtggctagttcgtccgtcgggtcccgccgtaacggttcccgaagggccgacgggcgtagggaagtggggtggccaaggtataataactaaatagttacgagtagaaactaaagttaaaaatattaactaagttgggaaactaccttacccgttacgaaaacggggtccctaagtttaccaaaccctacttaccctaccgaaagtaacgaaacctaaacgtttaacccaaaaggtaaacctaaggttgggttaataaccgtacttaaggaaccttaaaagtaacgaacgaacgtacgtacgacggacggacggaacggtaacggtacggttaacgtttaacgttaacggtaaggtaacggtaaacgtaacgtaacgtacggtacggtacgtacg

SEQ ID NO: 304916 - DNA, 705 bp, Homo sapiens
  misc_feature: GZ8MTXP02G5CLI.10.71.G05.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagngtgttcgctacgttcggttagggtgtatcaaacataaacgtccggcaggcctcccgaggcctcctcattctttgatgtctttacaacgcggcccctggcctcccgaggctaggttcaggtcggctaggtcgggtcgtggggaacacggtaccttcaccgttcctacaaccctatccaaggtccaacgtaccctaaggaccgtcccgtaaggtaaacgttagtttttcggaccgtttaagtttttaacttaaccgtgttacacggtaccgtaaggtccggttcgaccccgtttaacgggtttccggggacgggtaggtccgtacccggttacggtttccgggggacgggtaaaacgggtaaaaccctaaaaaggttacgggaaacgggttaaaccaaaaaccgggtacgttacggtacgggacctacggaaccctaacctacgttccgttacgttcctttaccgtactttccccg

SEQ ID NO: 304917 - DNA, 624 bp, Homo sapiens
  misc_feature: GZ8MTXP02GP0F7.10.71.G05.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtgtatcaacataaatccggcaggctcccaggctcctnatctttgatgtctttcaacgtacgggcccccttgggcccgtccccgagggcctagggttccaggtcggctaggtggggtcctaggggactaggtaccttcaccgttcctcaccatccgagcacgccctagacgcctagaagtattttgcttagtttactactgtcagcagcgtgcctacgtttcggcggtaggtcgccgtacgtttcgggacggtaacggggaaccctaaaagtacggaacgggtaaccgaaaaccggtaacgttacggtacggaccgttacggaacccgtaacccaacgtttccgtacggttcctttaccgtaacttttcccccg

SEQ ID NO: 304918 - DNA, 502 bp, Homo sapiens
  misc_feature: GZ8MTXP02JJVBX.10.71.G05.1.454.CMB.2.raw
  modified_base (336)..(336): a, c, t, g, unknown or other
  misc_feature (336)..(336): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagactctcctgttctgcgtctggattcatcttagtaatctgcatgtcctggtccgcaggttccaggccagggctggatgggtgccagatanacatatgatgacagtaaaatatactatgagactcttcaagggcattcaccatctccagagacaaattccaaagaacataggtgtatctgcaaatgaccagcctagagacgccgaaggacacgggtgtttaatacgtggtagggaacgaaatccgtaagtcggacta

SEQ ID NO: 304919 - DNA, 586 bp, Homo sapiens
  misc_feature: GZ8MTXP02JL3UJ.10.71.G05.1.454.CMB.2.raw
  modified_base (350)..(350): a, c, t, g, unknown or other
  misc_feature (350)..(350): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgcttcttttaagagatgtccagtgtcagatgcagatgggtggagtcgtgggggagcggtggtccggcgtgggggtcctgagctctcctgttctgcgtctggattcattcttaagtaaatctggctatcgtccgtgggtccgccgtaggttccaggcccgacgggctagggaagtggggtgcagatanaccaatatgatgaacaagtaatataactagtggatactctacgaagggcctattacacctatcctacagaacgactaaattaccaaagaactagttagggtatatcgtagaacaaaatcgaacctagcctaggacgacgcccggaaggtacgtacggggttatttaacgttacgtggggtaacggtaagtaaaacgttccggtaggtacggactagtaccgtaccgtaggtttacg

SEQ ID NO: 304920 - DNA, 598 bp, Homo sapiens
  misc_feature: GZ8MTXP02JIJ7P.10.71.G05.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaattgtgttgacacagtctccagccacgctgtctttgtctccgaggggaaangccaccctctcctgcagggccagtcagagtgttcgctacttcggttagggtgtatcaanataatccggcaggctccaggctcctnatcttgatgctttcaacgcggccctggccgtccaggcaggttcagtggctggtcgggtctgggacagtcttcactcncacatcagctacgctagacnccgtagaacgttntttgactagtttacttactgtacagtcagtcgttgcccttacggtttcgggacggtaggtcgacccgttacggtttcggggaccggtaacggggtaaaccaaaaggttacggaacggttaccgaaaacggtacgtacgggttacggacttcggacctaaccgtcgttacgttcgttccttaactaccttcccgtttaccccg

SEQ ID NO: 304921 - DNA, 621 bp, Homo sapiens
  misc_feature: GZ8MTXP02ICID7.10.71.G05.1.454.CMB.2.raw
  modified_base (198)..(198): a, c, t, g, unknown or other
  misc_feature (198)..(198): n is a, c, g, or t
tcagcatagtagtgcacgaccggtgctcgatttagtgtcgtcgcaagagagagggggaactgctcagttaggacccagagggaaccatggaagccccagctcagcttctcttcctcctgctactctggctcccagacaccaccggagaaattgtgttgacacagtctccagccacgctgtctttgtctccaggggaangccacctctcctgcagggccagtcagagtgttcgctacttcgttagggtgtatcaacataaatccggcaggctccaggctcctcatctttgatgtcttttcaacacgggccccctgggccgtccccagggcctaggttcagtggcaggtcgggtctgggacagacttcactctcaccatccagcagcctagacgcctagaagtattttgacttagttttattacttgtcagcaggtcgtcgtccgtacgtttcgggacggtaggttcgaccgttacgtttcgggacggtaacggggaaacctaaaaaggttaacggacgggttaaaccaaaacggtaaaccgttcggttacggggacctttacgggacctaacccgtaattaccgtttacggttacctttcctaacgtttccctttacccccg

SEQ ID NO: 304922 - DNA, 550 bp, Homo sapiens
  misc_feature: GZ8MTXP02I1USC.10.71.G05.1.454.CMB.2.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaangccacctctcctgcagggccagtcagagtgttcgcacttcgttagggtggtatcaacataaatccggcaggctcccaggctcctcatctttgatgtctttcaacgagggcccctggccgtcccaggcaggttcagtggcagtgggtctgggacagacttcnctctcaccatcagcagcctagagcctagaagtattttgctagtttatactgtcagcagcgtgcctacgtttcggcggtaggtcgccgtacgttcgggacggacgggaacctaaaaggtacggaaggtacgaaaacggtacgtggtacggctcggaacctactacgttctcgttacttctactttcccg

SEQ ID NO: 304923 - DNA, 585 bp, Homo sapiens
  misc_feature: GZ8MTXP02GFCTI.10.71.G05.1.454.CMB.2.raw
  modified_base (292)..(292): a, c, t, g, unknown or other
  misc_feature (292)..(292): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtcctgagctctcctgtctgcgtctggattcatcttagtaatctggcatgtcctgggtcccncctaggttccaggcccacggggctgggaatggggtgcagataatacaatatgatgaacaagtaaaatntactaatgggactactaccttacgaaacggggccctaattccaccatcctaccagacgaactaaattcccaaaagaactagtggtagtaatctagacaaaatcgaaccagtacctggaacgacggaccgaagggaactacggggtttagtttaattacggtaggttagggaaacgtaaacttccgtaaggtcggacctacgtacctaccgttgggttaatttcgg

SEQ ID NO: 304924 - DNA, 614 bp, Homo sapiens
  misc_feature: GZ8MTXP02GFFWX.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtcctgagctctcctgttctgcgtctggattcattctttagtaaatctggctatcgtccgtgggtcccgccgtacggttcccagggcccgacggggtctagggaagtggggtggccagataagtacaatatgatgaaactaaagttaaaatagtaactaagtagggaactaccttaccgttacgaaacgggtcccgtaatttaccacctaattcctaccaagacgaaacctaaacttaaccaaacgtaacagttagggttataactctagaacaaaattcgaaccgtagcctaggaacgacgacccggaggtaaccgtacgggttatttaacgttacgtaaggtacgggaataaaactccgtaaggtggactacg

SEQ ID NO: 304925 - DNA, 546 bp, Homo sapiens
  misc_feature: GZ8MTXP02IVK0J.10.71.G05.1.454.CMB.2.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctccagacaccaccggagaaattgtgttgacacagtctccagccacgctgtctttgctccgaggggaanagccaccctctcctgcagggccagtcagagtgttcgctacttcggtagggtgtatcaacataaatccggcaggctccaggctccncatctttgatgtctttcaacgcggcccctggcctcccaggcaggttcagtggcaggtggtctgggacagacttcactctacaccatcaagcagcctagacncctagaagtntttgctagtttactactgtcagtcagtcgtcgcctacgtttcgggcgtaggtcgacctacgtttcgggacggtaacgggaacctaaaagtaggacggtacaaaacgtacgtgtacggctagaaccaccgatcgtcgtcttacacttcccg

SEQ ID NO: 304926 - DNA, 547 bp, Homo sapiens
  misc_feature: GZ8MTXP02GHBQT.10.71.G05.1.454.CMB.2.raw
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatctttagtaaatctggcatgtcctgggtcccgccgaggttccaggccacggggctggaatggggtggccagatatacaatangntgaacaagtaaaatatactatgagactccttcaagggccgattcaccatcctcagtagacaattaccaagaacatcgggtagtatctagacaaatcgaaccagcctagacgaagccggaaggacgtaccggggttagttttaacgtacgtaaggtagggaacgtaaaacgtccgtaggtcggactaacg

SEQ ID NO: 304927 - DNA, 565 bp, Homo sapiens
  misc_feature: GZ8MTXP02GCA7A.10.71.G05.1.454.CMB.2.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttaggggtgtatcaacataaatccggcaggctcccgaggctcctcatctttgatgtctttcaacncggcccctggcctcccaggcaggttcaggtgcaggtgggctgggacagcttnctctcacatcagcagcctagacgctagaagtatttgcttagtttattactgtcagcagcgtnccgtacgtttcggcggtaggtcgtccgtacgtttcgggacgggaacgggaacctaaaagtacggaacggtaacgaaaacggtacgtcggtacggacgtcggaaccgtaccgacgttcgttgttccttactactttccccg

SEQ ID NO: 304928 - DNA, 574 bp, Homo sapiens
  misc_feature: GZ8MTXP02GE7G4.10.71.G05.1.454.CMB.2.raw
  modified_base (344)..(344): a, c, t, g, unknown or other
  misc_feature (344)..(344): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattcttagtaatctggcatgtcctgggtcccgcaggttccaggccacgggctggaagtggggtggccagatanacaatatgatagaattaagtaaaaacttataacttagtagggaagtaccttaccctttacgaaacggggtcccgaatttaccaaccctatccctaccaagacgaactaaacttaccaaagaacagtggtagtaatctagacaaatgaccagccctaggacgagacccggaaggacgtacggggttattagtttacgtggtagggaagtaactccgtagtcggtactaacg

SEQ ID NO: 304929 - DNA, 547 bp, Homo sapiens
  misc_feature: GZ8MTXP02GL76K.10.71.G05.1.454.CMB.2.raw
  modified_base (505)..(505): a, c, t, g, unknown or other
  misc_feature (505)..(505): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggcgtgggggtccctgagactctcctgttctgcgtctggattcatcttagtaaatctggcatgtcctggtccgcaggttccaggccacgggctggaatggggtggccagatatacaatatgatgacaagtaaaatatactatggagtactccttcgaaacggggccaagttcaacctatacctaccagacgaaactaaacttacccaaagtaaccagtaggtagtaatcctagacaaaatgaccaagcctagagacgccggaaggacgaccgggttnttaatacgtggtaggaagtaaacgtcctaggtcggactaacg

SEQ ID NO: 304930 - DNA, 524 bp, Homo sapiens
  misc_feature: GZ8MTXP02HHFME.10.71.G05.1.454.CMB.2.raw
  modified_base (485)..(485): a, c, t, g, unknown or other
  misc_feature (485)..(485): n is a, c, g, or t
  modified_base (505)..(505): a, c, t, g, unknown or other
  misc_feature (505)..(505): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggccgtggggggtccctgagactctcctgttctgcgtctggattcattcttagtaatctggcatgtcctgggtccgccaggttccagggccacgggctggaatggggtggccagatatacaatatgatgaacagtaaaatatactatggagactccttagaagggccattcaccatcctcagagacaattccaagaacatggtagtatctagacaaatcgacctagcctagagaggcccgaagggacacggggtntttattacgtggtagggaanaaactccgagtggactacg

SEQ ID NO: 304931 - DNA, 606 bp, Homo sapiens
  misc_feature: GZ8MTXP02G2ZCF.10.71.G05.1.454.CMB.2.raw
  modified_base (310)..(310): a, c, t, g, unknown or other
  misc_feature (310)..(310): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgcttcttttgagagatgtccagtgtcagatgcagatgggtggagtcgtgggggagcgtggtccggccgtgggggtccctgagactctctgttctgcgtctggtattcattctttaagtaaatcgtggctatcgtccgtggggtcccnccgtacggttcccgaggcccgacgggctggaagtggggtgcagatatacaatatgatgaacagtaaaatatactagtggaatctactacgaagggcctatcactatctccagacgaactaaacttaccaaagaaactagtaggttagtacttcgtagaactaaaagtcgaaccctaagtacccgtaggaaacgacggtacccggaagggacccgtagggttagtttaacttacgtacgggtaggaaagtaaaacgttccgttaaggtcggactaacgttcccgtaacgtttacggg

SEQ ID NO: 304932 - DNA, 606 bp, Homo sapiens
  misc_feature: GZ8MTXP02JZ8FB.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggccgtgggggtccctgagactctcctgttctgcgtctggattcatctttagtaatctggcatgtcctgggtccgccaggttccagggccacggggctggaagtggggtggccagatatacaatatgatagaacaagtaaaactataactagtggaagaccttcccttacgaaaggggcccgtaattccaaccctacttcctaccaagacgaaacctaaatttacccaaaaggaacctagttcgggtagttactcgtagacctaaaatcgaaccacgcctaggaaggacggcccggaagggtaccgtacgggggttagttttaacgttacggtgggtacgggaacgtaaaacgttccgttaggtcggactaacg

SEQ ID NO: 304933 - DNA, 537 bp, Homo sapiens
  misc_feature: GZ8MTXP02FN3QI.10.71.G05.1.454.CMB.2.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgtggttttcctcgttgctctttaagagatgtccagtgtcagatgcagatggtggagtcgtgggggagcgtggtccggcgtgggggtccctgagctctcctgttctgcgtctggattcatctttagtaaatctggcatgtccgtgggtcccnccgaggttccaggccacggggctggaagtgggtggcagatatacaatatgatganaagtaaatntactatgagactctcaagggccattccacactctaccaganaacaattccaaagaactagtgggtatattntaagttaaaatacgacacgacgtagacgacgtacgagtacgtaggttattagtacgtaggacggtaagtaactcgtagtcgactacgtcgtacgtagtactcggtcg

SEQ ID NO: 304934 - DNA, 508 bp, Homo sapiens
  misc_feature: GZ8MTXP02GLV7Q.10.71.G05.1.454.CMB.2.raw
  modified_base (421)..(421): a, c, t, g, unknown or other
  misc_feature (421)..(421): n is a, c, g, or t
  modified_base (462)..(462): a, c, t, g, unknown or other
  misc_feature (462)..(462): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggcctgggggtccctgagactctcctgttctgcgtctggattcatcttagtaaatctggcatgtcctgggtccgccaggttccaggccacgggctggaatggggtggcagatatacaatatgatgacagtaaaatatactatggagactcttcaaaggccattcaccatctccagagacaattcaaagacatggntatctgacaatgaccagcctagagagccgaggctacgggtntttactacgtggtagggaagtaatccgtagtggacactacgtaacg

SEQ ID NO: 304935 - DNA, 562 bp, Homo sapiens
  misc_feature: GZ8MTXP02GA818.10.71.G05.1.454.CMB.2.raw
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcggtggtttcgcgtaggctctttaagagatgtccagtgtcagatgcagatggtggagtgtggggaggcgtggtcggccgtgggggtccgtgagctctcctgttctgcgtctggtntntatnttatatntgcntcgtcgtcggtccgcgtacgtcgacggccgacggcgtaggtagtggtggcgagatatactaatatagatagtaataaataaatataatagtagtagtactactacgtacggacgtactactacactctacagactaactaactaacaacgaacagtagtagtatactagtactaactacgacgacgacgagagacgacgacggtacggtacggttagtttacgttacgttaggtacggtaacgtaacgtacgtaacgtcgacgtactacgtacgtacgttacgttcg

SEQ ID NO: 304936 - DNA, 697 bp, Homo sapiens
  misc_feature: GZ8MTXP02I85KK.10.71.G05.1.454.CMB.2.raw
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtggtccggccgtgggggtccctgagctctcctgttctgcgtctggattctattctttagtaaatctggctatgtccgtggggtcccnccgtaggttccagggcccacgggctggaagtggggtgccagatatacaatatgntagactaaagtaaaatatactagtgggaacgtaccttaccgttacgaaacggggtcccgtaatttacccaccctattccctacccgaaaggaaccgtaaactaaaactttaccccaaaaaggtaaacctaagttaggggttaactaacttccgttaggaacctaaaaagttccggaaacccacgggaccccttaggaaacgggaacgggaccccgggaaaggggtaacccggttaacgggggtttacgtttttaacgttaaaccggttggggttaaacgggggtaaaattaaaacgttcccggttaaagggttccgggaactttaaccgg

SEQ ID NO: 304937 - DNA, 541 bp, Homo sapiens
  misc_feature: GZ8MTXP02JIQ60.10.71.G05.1.454.CMB.2.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccacctctcctgcagggccagtcagagtgttcgcacttcggtaggggtgtatcaacataaanccggcaggcctccaggctcctcatctttgatgtctttcaacacgggcccctggccgtcccaggccaggttcaggtggcaggtggggtctgggacagacttcactctcaccatcagcagcctagagcctagaagtatttgctagtttatactgtcagcagcgtgcctacgtttcggcggtaggtcgtccgtacgtttcgggacgggaagggaacctaaaagtaggaaggtacgaaaacgtactgtacgctgaacacgactctcgtctcacttccc

SEQ ID NO: 304938 - DNA, 598 bp, Homo sapiens
  misc_feature: GZ8MTXP02GY2WZ.10.71.G05.1.454.CMB.2.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcggttaggggtgtatcaaacataaatccggcaggctcccaggctcctcatctttgatgtctttacaacgcgggcccctggccgtcccgaggcagggttcaggtggcaggtgggtctggggacagaccttcnctctcaccatcagcacgcctagacgcctagaacgtagttttgacttagtttattacgtgtacagctagcgtgcccttacgtttcgggcggtaggtcgtccgtacgtttcgggacgggtaacggggaacctaaaaggtacggaaggtaaccgaaaacggtaacgtcgtacggtactacggaacctaccgagttccgtagttcctttaccgtaacgtttcccccg

SEQ ID NO: 304939 - DNA, 617 bp, Homo sapiens
  misc_feature: GZ8MTXP02JBJ18.10.71.G05.1.454.CMB.2.raw
  modified_base (358)..(358): a, c, t, g, unknown or other
  misc_feature (358)..(358): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtccctgagctctcctgttctgcgtctggattcattcttagtaaatctggcatcgtccgtgggtcccgccgtaggttccacggtcccgacggggctagggaagtggggtgcagatataccaatntagatagaactaagtaaatataactagtaggaagtactccttacgaaacgggtccaattaccaacctatccctaccaggaacaactaattaccaaaagaaactagtaggtagtatcgtagaacctaaatcgaaccagtccgtaggacgacgacccggaaggaccgtacgggggttatttaaacgttacggtaggtaggggtaaactaaaacgttccgtaaaggtacggactaacgttacctaaccggttaggtttaacg

SEQ ID NO: 304940 - DNA, 665 bp, Homo sapiens
  misc_feature: GZ8MTXP02G49C7.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctggagctctcctgttctgcgtctggattcattctttagtaaatctggctatcgtccgtgggtcccgccgtaggttccgacgggcccgacggggtctagggaagtggggtggccgagatataacaatatagatagaactaaagtaaaatataactatagggaacgtaccttacccgttacgaaacggggtcccgtaatttaccaaccctaacttcctaaccccgaaagaacgtaaacctaaactttaacccgaaaaggtaaacctaagttagggttagtaacttacgttagaactaaaagttcgaaccagtacccgtaggacggacgacccgggaaaggtaacccggtacggggtttagtttaacgttaacggtaagggtaggggtaaacgtaaaacgtaccgttaggtacggactaacg

SEQ ID NO: 304941 - DNA, 669 bp, Homo sapiens
  misc_feature: GZ8MTXP02IXX43.10.71.G05.1.454.CMB.2.raw
  modified_base (324)..(324): a, c, t, g, unknown or other
  misc_feature (324)..(324): n is a, c, g, or t
tcagcatagtagtgcacgaccggtgctcgatttagtgtcgtcgcaagagagagggggagctctgggagaggagcccagcactagaagtcggcggtgccctccattcggtgatcagcactgaacacagaggactcaccatggagtttgggctgagcttgggtttttctcgttgcttcttttaagagatgtccagtgtcagatgcagatgggtggagtcgtgggggaggcggtgggtccggccgtgggggtccctggagctctcctgttctgcgtctggattctattctttaagtaaatctggctagttcgtccgtggggtccccnccgtacggttcccgacgggcccgacggggcgtagggaagtggggtgccgagatataacaatagtgatagaaactaaagttaaaaactataactaagtgggtaaactaccttacccgttaccgaaacggggtacccgtaattaccaacctacttacccaccgaagaacgtaaacctaaacttaccgaaaagtaaccagttagggtagtaactacgtacgtaacaaaacgtcgaacccgacgtacccgtaggacgaccggaccgaaacgggtaaccgttacgggtttagtttaaccgttaggtaaggtagggtaaacgtaaacgtccgttaaaggtcggactaaccg

SEQ ID NO: 304942 - DNA, 609 bp, Homo sapiens
  misc_feature: GZ8MTXP02G38BA.10.71.G05.1.454.CMB.2.raw
  modified_base (202)..(202): a, c, t, g, unknown or other
  misc_feature (202)..(202): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaangccaccctctcctgcagggccagtcagagtgttcgctacttcggttaggggtgtatcaacataaatccggcaggctcccaggctcctcatctttgatgtctttcaacgacgggtccccctggccgtcccaggcctaggttcaggtggcaggtgggtctgggacagacttcnctctcaccatcagcagcctagacgcctgaaagtntttcgctagtttacttactgtctagcagcgttgcctacgtttcgggacggtacggtcgtccgtacggtttccgggacgggtaacggggaaccctaaaaaggtacggtaaacgggtaacccgaaaacggtaaaccgtcggtacgggtcttacggaacctaacccgtaacgttccgtacggttacctttacgtacgtttccccg

SEQ ID NO: 304943 - DNA, 629 bp, Homo sapiens
  misc_feature: GZ8MTXP02GZZSN.10.71.G05.1.454.CMB.2.raw
  modified_base (303)..(303): a, c, t, g, unknown or other
  misc_feature (303)..(303): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcatcttagaatctggcatgtcctgggtccncaggttccaggccacgggctaggatgggtgccagatatacatatgatagactaagtaaaatataactatggaagtactacccgttacgaaacgggtcccgtaattaccaacctaatcctacccaaagaacgaaacctaaactttacccaaaaggtaaacctagttaggggtagttaactaccgttagacctaaaaagttcgaaacccgaggtacccctaggaacgaacggacccggaagggtaaccgtaaccgggggtttatttaacgtttaaccggtggtacggggaaaggtaaaacttcccgtaaggttacgggacttaaaccg

SEQ ID NO: 304944 - DNA, 527 bp, Homo sapiens
  misc_feature: GZ8MTXP02GDIJ8.10.71.G05.1.454.CMB.2.raw
  modified_base (460)..(460): a, c, t, g, unknown or other
  misc_feature (460)..(460): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggccgtgggggtccctgagctctcctgttctgcgtctggattcatcttagtaatctggcatgtcctgggtccgccaggttccagggcccacggggctggaatgggtggccagatatacaatatgatgaacagtaaaatataactataggagactccttacgaaagggccgattcaccatctccagagaacaattaccaaagaacataggtagtatctagacaaatgaacngctagagagaccgaggacacgggttattagttacgtgtagggaagtaaagtcctagtcggactaacg

SEQ ID NO: 304945 - DNA, 780 bp, Homo sapiens
  misc_feature: GZ8MTXP02IHANO.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggtagtttgggctgagtcttgggttttcctcgttgcttcttttaagagtatgtccagtgtcagatgcagatggtggagtcgtgggggaggtcggtcgggtccggccggtgggggtccctggacgactctctgttctgcgtctggattcattcttaagtaatcgtggctagttcgtccgtcgggtccgaccgtacggttcccgacgggcccgacgggtcgtagggaagttggggtcggacccaagtaagttaactaaacgaaattagtagtagtagtaaaactaaagtttaaaaaattagttaacgtaaagtacgggtaaacttaccctacccgtttaacgggaaacgggtacccgttaactttacccgaacccgtaacttccccgtaccgaaacggtaaacgtaaaccttaaactttaaccccgaaaaggtaaacctagtttaggggttattaacgttacgttaacgaaaccgtaaaacgttacgaacccgtaacggtaacccgtagggaaacgggtaaccggaccccggtaaagggaacccggtttacgggggtttaaacgttttaacgtttaacgggtaaggggttaacgggtaaaacgttaaaaccggttccgttaacgggttacggaactttaaccgg

SEQ ID NO: 304946 - DNA, 593 bp, Homo sapiens
  misc_feature: GZ8MTXP02HBQA0.10.71.G05.1.454.CMB.2.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagttgttcgctacttcggttagggtgtatcaacataaactccggcaggctcccaggcctcctcatctttgatgtctttacaacacgggcccctggccgtcccgaggctagggttcaggtggcacggtgggtctggggacagtacttcnctctcaccatcagcagcctagacgctgaagtactttgctagtttactactgtcagcagcgtgcctacgtttcgggcggtaggtcgaccgttacggtttcgggcgggaaacgggtaaccctaaaaagtcggaacgggtaaccgaaaacggtacgtagggttacggcgttacggaaccctaacgacgttccgttagtccctttacgtaactttccccg

SEQ ID NO: 304947 - DNA, 626 bp, Homo sapiens
  misc_feature: GZ8MTXP02IWSQX.10.71.G05.1.454.CMB.2.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttaggggtgtatcaacataaactccggccaggcctcccgaggcctccctcattctttgatgtcctttacacgcggcccctggccgtcccgaggcaggttcaggtggcaggtggtctgggacagtacttcnctcncaccntcagcagcctagacgtcctagaacgttatttcgcttaagtttacttacgtgttcgagctaggtccgtgtcccgttacggtttccggggacggtacgggtcgtacccgttacggtttccggggacgggtaaacgggaaacccgtaaaaggttacggaacgggttaaaccgaaaacggtaaccgttgggtacggccttacggaaccaccgtactccgttacgttccttacgtactttccccg

SEQ ID NO: 304948 - DNA, 510 bp, Homo sapiens
  misc_feature: GZ8MTXP02JMXV9.10.71.G05.1.454.CMB.2.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (471)..(471): a, c, t, g, unknown or other
  misc_feature (471)..(471): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatctttagaatctggcatgtcctggtccncaggttccaggccagggctggaatggggtgccagatatacatatgatgacagtaaaatntactatgganactccttnaagggccaattcaccatctccaganacaattccaagaacatggtatatctgacaaatgaccagcctagagagaccgaggtaccacggggttntttatagtggtaggaagtaaactccgtaagtggactaac

SEQ ID NO: 304949 - DNA, 549 bp, Homo sapiens
  misc_feature: GZ8MTXP02GD6V5.10.71.G05.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggccgtggggggtccctgagactctcctgttctgcgtctggattcatcttagtaaatctggcatgtctggtccncaggttccaggccagggcgagagtgggtgacagtatactanaatagtagatacgataaagtaaatntaatagngacgtcttctagacggactataccacactcacganacgaacttactaaccaaanagtagtagtatactaganactaacacgacgacgtacgagagacgacgacggtacggtacgttagttacgttagtaggtacgtaacgtaacgtacgtaagtacgactactacgtacgtacgttacgtcg

SEQ ID NO: 304950 - DNA, 528 bp, Homo sapiens
  misc_feature: GZ8MTXP02HHILQ.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttaggggtgtatcaacataaatccggcaggctcccaggctcctcatctttgatgctttcaacaggcccctggctcccaggcaggttcagtggcagtgggtctgggacagacttcactctcaccatcagcagcctagacgcctgaagtattttgctagtttatactgtcagcagcgtagcctacgtttcggcggaggtcgccgtacgtttcgggcggtaagggaacctaaaaagtagaggtacaaaacgaactgtacggctgcgaccatctgtcttcactttccc

SEQ ID NO: 304951 - DNA, 537 bp, Homo sapiens
  misc_feature: GZ8MTXP02IAQ76.10.71.G05.1.454.CMB.2.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgagggggaaangccaccctctcctgcagggccagtcagagtgtcgcactttcggtagggtgtatcaacataaanccggcaggctccagctccnatctttgatgctttcaacngggcccctggcctcccaggcaggttcagtgcaggtgggctgggacagacttcnctctacacctatccagcagacctagacgcctgaagtattttgactagtttattactgtacagcagcgtgacctacgtttcggacggtaggtcgccgtacgtttcgggacggaacggggaaccaaaagtaggaaggtacaaaacgaacgtcgtgactgaacacatctgtcttcacttccg

SEQ ID NO: 304952 - DNA, 585 bp, Homo sapiens
  misc_feature: GZ8MTXP02HK72D.10.71.G05.1.454.CMB.2.raw
  modified_base (263)..(263): a, c, t, g, unknown or other
  misc_feature (263)..(263): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtgggtccggccgtgggggtccctgagactctcctgttcngcgtctggattcattcttagtaaatcgtggcatgtcctgggtccgcctaggttcccagggcccacggggctagggaacgtggggtggacccaagataataacaatattgactgaaacaaagtaaaatatacatggaanactccttacgaagggcccattccaccatcctaccagacgaactaaacttaccaaaagaactagtgggtatatcgtagaaccaaaatcgaaccaggccctaggaacgacggacccgaaggaaccgtacggggttacttttaatacgtaaggagggtaaagaaaacttccgtagtcggacctaacg

SEQ ID NO: 304953 - DNA, 539 bp, Homo sapiens
  misc_feature: GZ8MTXP02H2K81.10.71.G05.1.454.CMB.2.raw
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctggagactctcctgttctgcgtctggatttcattctttagtaaatctggcatgtcctgggtcccncaggttccagggccacgggctggaagtggggtggccagatagtacaatatgntgacagtaaaatatactatggagactcttnaaggcattcacatctccagagacaatccaagaacatggtagtatctagtacaaatcgaacagccctaggacgagcccgaaggtaccgtacggggttgtttagttaccgtggtagggaacgtaaacgtccgtaaggtcggactacg

SEQ ID NO: 304954 - DNA, 549 bp, Homo sapiens
  misc_feature: GZ8MTXP02GLT2T.10.71.G05.1.454.CMB.2.raw
  modified_base (262)..(262): a, c, t, g, unknown or other
  misc_feature (262)..(262): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggccgtggggggtccctgagactctcctgttcngcgtctggattcatcttagaatctggcatgtcctgggtccgccaggttcccaggccacggggctggaatggggtgccagatatacaatatgatgaacaagtaaaatataactatggaanacctccttacgaaacgggccgtaatttccaaccatacctaccgaagacgaacaaattacccaaagaaccatgggtatatctagactaaatcgaccagcctagagagccgaagggactacggggttatttattacgtggtaggaactaagtaccgtaggtacggcctaa

SEQ ID NO: 304955 - DNA, 518 bp, Homo sapiens
  misc_feature: GZ8MTXP02GOM82.10.71.G05.1.454.CMB.2.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagactctcctgttctgcgtctggattcatctttagtaaatctggcatgtcctgggtccncaggttccaggccacgggctggaatgggtgcagatatacaatatgatgaacaagtaaaatntaactatgagactctcgaagggccatcactatctacagagacaaatccaagaacatgggtatatctagacaaatgaccagcctgagagccggaaggacgtacgggttgtttaattacgtaaggtggaacgtaaactccgtaagtcggactaac

SEQ ID NO: 304956 - DNA, 557 bp, Homo sapiens
  misc_feature: GZ8MTXP02HGPIT.10.71.G05.1.454.CMB.2.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctcctgtctgcgtctggattcattcttagtaatctgcatgtctgggtccncaggtccaggccagggctggatgggtgccagatatacaatatgatgaacaagtaaaatattactatagggaacgtacctccttacgaaacggggccctaattccaacccatcctaccaagacgaaacaattaccaagtaaanagtaggtatagtcagaacaatacgacgacgacgtacgacgacgacggacggaacggtacggttacgttacgttacgtaaggtaggtaacgtaacgtacgtacgtacgtacgtacg

SEQ ID NO: 304957 - DNA, 590 bp, Homo sapiens
  misc_feature: GZ8MTXP02GGEE6.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatgggtggagtcgtgggggagcgtggtccggccgtgggggtccctgagctctctgttctgcgtctggattcattcttagtaaatctggcatcgtcctgggtcccgcctaggttccacgggccacgggctggaagtggggtgccagatatacaatatgatagaactaaagttaaaaatataactaatggaatactccgttacgaaagggccgtaattacacctaatcctaccaagaacgaaactaaacttaccaaaataacattagggtattaactctacgaactaaaactcgaaccacgaccctaggacgacgaccggaaggaacgtacggggttatttaacgttagtaaggttagggaagtaaaacgtccgtaagtcggactaacg

SEQ ID NO: 304958 - DNA, 606 bp, Homo sapiens
  misc_feature: GZ8MTXP02GK4OK.10.71.G05.1.454.CMB.2.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggcctcccaggctcctcatctttgatgtctttcaacgacgggcccctggccgtcccgaggcctaggttcaggtggcaggtgggtctggggacagacttcactctcaccatcagcagcctagacnccctgaacgtattttgacttagtttacttacgtgttcagtcagtcgtgccctacgtttcggacgggtaggtcgccgtacgtttcggggacgggtaacgggaaccctaaaagtacggaacgggtaaccgaaaaacggaccgttagggtacggtacgttacggaacccgaacccgtaacgttcgtacggttctttacctaactttcccccg

SEQ ID NO: 304959 - DNA, 581 bp, Homo sapiens
  misc_feature: GZ8MTXP02G562T.10.71.G05.1.454.CMB.2.raw
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcattctttagtaatctggcatgtcctggggtcccnccaggttccaggccgacgggctggaagtggggtgccagatatacaatangntgaacagtaaaatntactatgganactccttacgaagggccattcaccatcctacagacactaattaccaagaacattgggtatatcgtagacaaaatcgaaccagacccgtagacggacggaccgggaagggtaaccgtacgggggtttagtttaaccgtttaacggtgggttaaggggaaacgtaaaacgttcccggtaaggttacgggtacttaaacgg

SEQ ID NO: 304960 - DNA, 681 bp, Homo sapiens
  misc_feature: GZ8MTXP02JVA6X.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcgtggtccggccgtggggggtccctggagactctcctgttctgcgtctggattcatctttagtaatctggcatgtccgtgggtccgccaggttccaggcccgacgggctagggagtggggtggcagtactatacaatatgattgactaagtaaaatatactagtaggatacctacccttagaaacgggtcccgtaattacccaacccattccctaccaaggtaacgaaacctaaacttacccgaaaacgtaaaactagttaggggttattaacgttacgtacgtaaacgtaaaacgttcggaaacccacgggtaccctagggaaacgtaacgggacccgggaaagggaaacccgggtaacggggtttaggttttaacgtttaaccggttagggttaggggtaaaacggtaaaacgttacccggttaaaggtcgggtacctaacgttaccgtaaacccggg

SEQ ID NO: 304961 - DNA, 583 bp, Homo sapiens
  misc_feature: GZ8MTXP02IO051.10.71.G05.1.454.CMB.2.raw
  modified_base (363)..(363): a, c, t, g, unknown or other
  misc_feature (363)..(363): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaatctggcatgtcctgggtccgcctaggttccaggcccacggggctggaagtggggtgcagatatacaatatgatgacaagttaaaatntaactatggatacctcttagaagggcctatccacatctaccagacgacaattaccaagaacatggtgtatctagacaaatgaccagcctagacgacgccgaggtaaccgtacggggtttagtttaacgtttaacggttcgggtagggtaaacgtaaaacgttacccgttaaaggtcggtacctaacgttaccgtaacccgtttggttaaattttccgggg

SEQ ID NO: 304962 - DNA, 577 bp, Homo sapiens
  misc_feature: GZ8MTXP02GNEJK.10.71.G05.1.454.CMB.2.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttaggggtgtatcaacataaatccggcaggctcccaggctcctcatctttgatgtctttcaacgacgggccccctgggccgtcccgaggctaggttcaggtggcaggtgggtctggggacagacttcnctctcaccatcagcagcctagacgcctaggaagtattttgacttagtttattactgtcagcagcgtgcctacgtttcggcggtaggtcgccgtacgtttcgggacgggtaacgggaaccaaaagtacggaaggttaccgaaaacggtacgtaggtacggactaggaaccgtacctaagttctcggttaccttacgtactttcccg

SEQ ID NO: 304963 - DNA, 650 bp, Homo sapiens
  misc_feature: GZ8MTXP02IY3E5.10.71.G05.1.454.CMB.2.raw
  modified_base (566)..(566): a, c, t, g, unknown or other
  misc_feature (566)..(566): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatcttagtaaatctggctatgtcctgggtcccgccaggttccaggcccacgggctggaagtggggtggcagatatacaatatgatgacaagtaaaatataactatggaatactccttacgaaagggcccgaattccaacctattcctacccaagaacgaacctaaaacttacccgaaaagtaaaccaagttagggtagttaaatccgttagaacctaaaaagttcggaaacccacggtacccgtaggaaacggaacggtacccgggaaagggtaaccgtaaaccggggggtttnttttaaacgtttaacgtgggttaagggggaaaacgtaaaacgttcccggttaaaggtcggggtacctaacgttaccgtaaccgg

SEQ ID NO: 304964 - DNA, 319 bp, Homo sapiens
  misc_feature: GZ8MTXP02HZFHL.10.71.G05.1.454.CMB.2.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
  modified_base (317)..(319): a, c, t, g, unknown or other
  misc_feature (317)..(319): n is a, c, g, or t
tcagcatagtagtgcacgaccggtgctcgatttagtgtcgtcgcaagagagaggagggggggctgggaggcctttgttggagaccttgcacttgtactccttgccgttcagccagtcctggtgcacgacggtgaggacgctgaccacacggaacgtgctgttgaactgctcctcccgtggtcaccgtctcttcgcctccaccaaggcccatcgtctcccctgcgcctgctcaggancacctccgagagcacagcggccctggctgcctggtcaaggctactcccactactatgctgagcggctggcaaggcgnatgnnn

SEQ ID NO: 304965 - DNA, 596 bp, Homo sapiens
  misc_feature: GZ8MTXP02JHBAQ.10.71.G05.1.454.CMB.2.raw
  modified_base (227)..(227): a, c, t, g, unknown or other
  misc_feature (227)..(227): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcgnggtttccggcgtggggtcctgagctctcctgttctgcgtctggattcattcttaagtaatcgtggcatcgtccgtgggtcccgccgtaggttccacgggccgacggggcgtaggagtggggtgccagatatacaatatgatgaactaaagtaaaactataactagtaggaactacttccgttacgaaacgggcctattaccactatcctaccagacgaacaattaccaaagaactgtagggtatactcgttacgacaaaagtcgaaccgagtcccgagacgacgacccgggaaggaacgtaccggggtttagtttacgttaacggtggtaggggtaaacgtaaaacgtccgtaggttacggactaaccg

SEQ ID NO: 304966 - DNA, 543 bp, Homo sapiens
  misc_feature: GZ8MTXP02HPSPW.10.71.G05.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagngtgtcgcactttcggttaggggtgtatcaacataaatccggcaggctcccaggctctcatctttgatgtctttacaacgcgggcccctgggcctcccaggcagggttcaggtggcaggtgggtctggggacagtacttcactctcaccatcacgcacgcctagacgcctagaagtnttttgctagtttattactgtcagcagtcgtgcctacgtttcggcggaggtcgcctcggttcgggacgggtaacgggaacctaaaagtacggaggtacaaaacggactgacgctgaacactactctgtctctactcccg

SEQ ID NO: 304967 - DNA, 604 bp, Homo sapiens
  misc_feature: GZ8MTXP02JEJK5.10.71.G05.1.454.CMB.2.raw
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggtattcatcttagtaaatctggctatgtccgtgggtccgccgtaggttccacggcccgacggggcgtagggaagttggggtggaccgaggaatataacccaaattatgtataggaactaagtaaatataactagtaggatactctacgaacgggcctattacacatctacagaagtacaattaccaaagaacagtaggtatactcgtacgaacaaagttcgaaccagtccctaggaagacgaccggtaacggacggtaccgggttaagttttaacgtacgttaggtacgggaaagtaaacgtccgtaaggtcggacctagtacctaaccggttggtttaacgg

SEQ ID NO: 304968 - DNA, 831 bp, Homo sapiens
  misc_feature: GZ8MTXP02GHZYG.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgagctctcctgttctgcgtctggattcatcttagtaaatctggctatcgtccgtggggtcccgtccgtaggttcccgacgggcccgaccggggtctaggggaagtcgggggtaggaccccaaggtaacttaagtaaacctaaaagttaattaggtaagtacggaaaaccgtaaaaggttaaaaaaactttattaaaaccgttaagttacggggtaaacgtaacccgtttacccgtttaccggaaaacgggggtcccgtaaacgtttacccaacccctaagttaccccttaccgaaacgaacggtaaaccttaaaacctttaacccgaaaaacggtaaaccctaaaggtttagggggttaacgttaaactttccgttaacggaaccttaaaaaacgccggttaaaaccccgacggtaaccccggttaagggaaacgggtaaaccgggtaccccgggaaaacgggggttaacccgtaaccggggggtttttaacttttaacggtttaaaccggttaaggggttaaagggggtaaaacgtaaaaaccggtttaccggttaaacggggtacgggtaaccctttaaaccgg

SEQ ID NO: 304969 - DNA, 576 bp, Homo sapiens
  misc_feature: GZ8MTXP02H25Z1.10.71.G05.1.454.CMB.2.raw
  modified_base (259)..(259): a, c, t, g, unknown or other
  misc_feature (259)..(259): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (449)..(449): a, c, t, g, unknown or other
  misc_feature (449)..(449): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtcnggttatcattctttagtaaatctggctatgtccgtgggtcccgccgtaggtttcccacggccgacggggtctgggaagtggggtggcaagatagtaacaatatgatagaacaagttaaaatntaactatagganacttcctagaagggccatcacatctacagagactaataccaaagaactagtaggtntaattctagtaaatcgaccagcctaggacgacgaccggaggaacgtacggggttatttagtacgtggtaggaacgtaacgttccgtaggtcggactaacgtcctaccgttaggtactttaggtccgg

SEQ ID NO: 304970 - DNA, 718 bp, Homo sapiens
  misc_feature: GZ8MTXP02HR5RI.10.71.G05.1.454.CMB.2.raw
  modified_base (262)..(262): a, c, t, g, unknown or other
  misc_feature (262)..(262): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggcgtgggggtccctgagctctcctgttcngcgtctggattcatctttagtaaatctggcatgtccgtgggtcccgccgagggttccagggcccacggggctggaacgtggggtggccagatataacaatatgatgaactaagtaaaatataactaataggaagtaccttccgttacgaaacgggggccctaattcccaaccctaattcctaccccgaagaaacgaacctaaaacgtttaccccgaaaaaggtaaacctaagttagggggttagttaaactttacccgtaaggaaaccctaaaaagttccgggaaacccctaaacgggacccccgttagggaaaacggaaccgggacccgggaaaacggggtaacccggtaaccgggggtttacgtttttaaagtttaaacccggttggggttaacgggggtaaaacgttaaaacgttacccggttaaaagggtttccggggaaactttaacccgg

SEQ ID NO: 304971 - DNA, 638 bp, Homo sapiens
  misc_feature: GZ8MTXP02GZOUJ.10.71.G05.1.454.CMB.2.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgctacttcggttagggtgtatcaacataaatccggcaggctccaggctcctcatctttgatgctttcaacgcggcccctggccgtcccgaggctaggttcaggtggcaggtggggtctaggggactaggtacctttcgaccttcctacaaccctatcccgaaggccaacgtcccgttaaggacgtaccctaggtaaacgttatttttcgacttaaggttttaacttactgttacagtacctaggtccgttcgacccttacggtttcggacgggtaggttcgccgtacggtttcgggacgggtacgggaaaccgtaaaagtcggaaacggttaacgaaacgaaacgttcggtaggtaccgtggaaccaccgtacgttcgtgttccttaccgactttccccg

SEQ ID NO: 304972 - DNA, 558 bp, Homo sapiens
  misc_feature: GZ8MTXP02GYUKR.10.71.G05.1.454.CMB.2.raw
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtggggggtccctgagactctcctgttctgcgtctggattcatctttagtaaatctggcatgtcctgggtccgcctaggttccagggcccgacggggctagggaagtggggtggcccaggataatacaatatgatgaactaaagtaaaatataactatagganactccttacgaagggccattcaccatctaccaganacaacttcaaagacagtggtatatctagacaaatcgaaccagacctaggaacgtagaccggaggaacgtaccggggttatttaagtacgtgggtaggaaacgttaaactccgtagtcggactaacg

SEQ ID NO: 304973 - DNA, 564 bp, Homo sapiens
  misc_feature: GZ8MTXP02I81XM.10.71.G05.1.454.CMB.2.raw
  modified_base (353)..(353): a, c, t, g, unknown or other
  misc_feature (353)..(353): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaatctggcatgtcctgggtccgcaggttccaggccacgggctggaatggggtgccagatatacaatatgntgaacaagtaaaatatactatagggatacttctacgaacgggcctatcactatcctacagacaactaaacttaccaaagtacagttaggtagtactcgtagactaaagtcgactacgcctaggacgacgacccggtaggaaccgtacgggtttagtttaacgttacggtaagggtacggtaaacgtaacgtccgtaacggtggtactaacg

SEQ ID NO: 304974 - DNA, 585 bp, Homo sapiens
  misc_feature: GZ8MTXP02IJ92H.10.71.G05.1.454.CMB.2.raw
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcctgggggtccctgagactctcctgttctgcgtctggattcatctttagtaaatctggcatgtcctgggtccnccaggttccaggccacgggctggaatggggtgcagatatacaatatgatagacaagtaaaatntactatggagactcttanaagggcatcacatctccagagacaattccaanaacatggtntatctagacaaaatgaaccagcctaggaagacggacccgaaaggggtaccgtaacgggggtttagttttaaacgtttaacgttacgggttagggggaaacgtaaaacgttcccgttaaaggttcgggacctaacgttacccgtacccgttagggtttaattttacggg

SEQ ID NO: 304975 - DNA, 521 bp, Homo sapiens
  misc_feature: GZ8MTXP02JPBT5.10.71.G05.1.454.CMB.2.raw
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
  modified_base (498)..(498): a, c, t, g, unknown or other
  misc_feature (498)..(498): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcatctttagtaaatctggcatgtcctgggtccnccaggttccagggccacgggctggaatggggtgccagatatacatangatgaacaagtaaaatntactatgagactccttgaagggccattcaccatctccagagacaattcaagaacatggtntatctagacaaatgacagcctagagagccgtaaggacgtacgggtagtttaacttagtaagaggggtaanaaacgtacctaggtcggactacg

SEQ ID NO: 304976 - DNA, 608 bp, Homo sapiens
  misc_feature: GZ8MTXP02ILIER.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaangccaccctctcctgcagggccagtcagagtgttcgctactttcggttagggtgtatcaacataaatccggcaggcctcccaggcctcctcattctttgatgtctttacaacacgggtcccctgggccgtcccgaggcaggttcaggtggctaggtcggggtctggggactaggtacctttcaccttcacacctatccagcacgctagacgctagagtattttgacttagtttacttactgtcagtctaggtcgttgaccttacgtttcgggaggtacggtcgtccgtacggtttcggacgggtaacgggtaaacctaaaaggtacggtaaacggtacaaaacggtacgttacggtacggacgtgaaccgtacgtacgttcgttacgttcctttactacgtttcccg

SEQ ID NO: 304977 - DNA, 705 bp, Homo sapiens
  misc_feature: GZ8MTXP02IUSDH.10.71.G05.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcgtgggtccggccgtgggggtccctgagctctctgtctgcgtntggnttcatcttagtaatctggcatcgtcctcgggtcccgccgtacgggttccacgggcccgaacggggtccgtaggggtaacgtggggtacggcccgtagaatataacaataatgatgaaactaaagttaaaatataactaagtggaaacgtaccttacccgttacgaaacggggcccgtaactttaccaacccacttccctaccgaaagacgtaaacctaaacttaaccgaaaacgtaaacaggtttagggtacgttaactcgtacgaactaaacgtaccgaaaccgacgtaccgtacggaacggaaccgggacccggtaaacggggtaccggttaacgggggtttacggttttaaacgttaaccggttaaggggttaaagggtaaacggttaaaaccggttacccggtttaaggtacggggtaccttaaacccgg

SEQ ID NO: 304978 - DNA, 659 bp, Homo sapiens
  misc_feature: GZ8MTXP02JDSM1.10.71.G05.1.454.CMB.2.raw
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctggagctctcctgttctgcgtctggattcattctttagtaaatctggcattgtccgtgggtccgctacggttccaggcccagggcctgggaagtggggtgcagatataccaatatgatgaacaagtaatatactagtggaagtacctaccgttacgaaacggggtcctaattacccaaccacttaccctacccaagaacggaacctaaacgtttacccgaaaagtaaacctaagtttagggttacggttaactacccttagggaacctaaaaacgtcggaaaccccaggtacccgtaggaacggacggacccggtaaggggtacccgtaaaggggtttcgtttaaacgtttacgtacgggtaagggtaacgtaaaacgtccggtaaggttcggactacttaccgtaccgtttaggtttacg

SEQ ID NO: 304979 - DNA, 523 bp, Homo sapiens
  misc_feature: GZ8MTXP02IN6HQ.10.71.G05.1.454.CMB.2.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggacttaccatggagtttgggctgagcgtgggttttcctcgttgctcttttaagagatgtccagtgtcagatgcagatggtggagtcgtgggggaggcgtggtccggctgggggtccctgagactctcctgttctgcgtctggattcatctttagtaaatctggcatgtcctgggtccnccaggttccaggcccacgggctgggaatggggtgcagatatacaatntgatgacaagtaaaatatactatgganactcctgaaggccattcaccatctcaganacaatccaaagaacntggtntancgtananananacacacgagacgacgacgacggacgtacggtacgttacgttagtagtaaggtagtaacgtacgtacgtacgtacgactacg

SEQ ID NO: 304980 - DNA, 546 bp, Homo sapiens
  misc_feature: GZ8MTXP02IEONP.10.71.G05.1.454.CMB.2.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggagaaagnccacctntcctgcagggccaggtcagagtgttcgctacttcgttaagggtgtatcaaacataaatccggacaggcctcccaggctcctnattctttgatgcttcaacnggcccctggctccaggcaggttcagtggcagtggtctggggacagacttcgactctccacatcgancacgctagacgctagagtatttcgctagttattatgtatagtacagtcgtcgtacgtacgttacggtacggtagtcgtcgtacgttacggtacggtacggaacgaaaagtaagacgtaacgaaacgtaacgtacgtacgacgtcgacgactactacgtcgtactactacg

SEQ ID NO: 304981 - DNA, 611 bp, Homo sapiens
  misc_feature: GZ8MTXP02HSDSM.10.71.G05.1.454.CMB.2.raw
  modified_base (261)..(261): a, c, t, g, unknown or other
  misc_feature (261)..(261): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcgtggtccggcgtgggggtccctgagctctcctgttcngcgtctggattcattctttagtaaatcgtggctagttcgtccgtcggggtccccgccgtacggttccgacgggcccgacggggcgtgggaagtggggtggaccgaggtatagtaacaaattagtagagtagaactaaagttaaaaattataacttatagggacgtacttcccgttagaaacggggccgtaatttaccacctatacctcccaagagaacctaaattaccaaagtaacagttgggtataactcgtagactaaatcgaacagcctagaggacggacgagggaccgtacgggttatttaacgtacgtaaggtcgggaaactacgtaccgtaggtacggctaacg

SEQ ID NO: 304982 - DNA, 710 bp, Homo sapiens
  misc_feature: GZ8MTXP02HXD39.10.71.G05.1.454.CMB.2.raw
  modified_base (312)..(312): a, c, t, g, unknown or other
  misc_feature (312)..(312): n is a, c, g, or t
  modified_base (485)..(485): a, c, t, g, unknown or other
  misc_feature (485)..(485): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggcgtgggggtccctggagactctccgtgttctgcgtcgtggtactctattctttaagtaaattcgtaggcagttcgtccgtcgggtcccnccgtacggttccacggcccgaggcgtggaagtggggtgcagaactagtaacaatatagagtacataaaagttaaaatataactaagtggacgtacctcttacgaacgggtccaattccaactatacctaccaagacgtaactaaacttcccaaaagaaccgtagttagggttnttaacgtttcgtaacgaaaccgtaaaaattccgaaaccgaacggtttaccaggaaacggaacggaccccgggaaaagggtaaccggttaaaaccggggtttttaggttttaaaacctttaacggggttacgtacgggggtaaaaaataaccgtttacccgaaagggtttaccggaaacgtacttacccgttaaaccggtttacgggttttaaaacgttttcgggg

SEQ ID NO: 304983 - DNA, 539 bp, Homo sapiens
  misc_feature: GZ8MTXP02GD7YL.10.71.G05.1.454.CMB.2.raw
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcattctttagtaaatctggcatgtcctgggtccnccaggttccaggccacgggctggaatggggtgcccagatagtacaatangatgaacaagtaaaatntaactatgagactcccttagaacgggcctattacacctatctccagagaaacattaccaaagtaacagtgggtatatctgacaaatgacagcctagagacgcgaggacgacgggttnttaattacgtaagttgggaataaaacgtccgtaaggtcggtactaacg

SEQ ID NO: 304984 - DNA, 518 bp, Homo sapiens
  misc_feature: GZ8MTXP02G7XGQ.10.71.G05.1.454.CMB.2.raw
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaagagccaccctctcctgcagggccagtcagagtgttcgcacttcgttaggggtgtatcaacataaatccggcaggctcccaggctcctcatctttgatgctttcaacgacggcccctggccgtcccaggcaggttcagtggcacggtgggtctgggacagacttcnctctcaccatcagcagcctagcgctgaagtntttgctagtttatactgtcagnagcgtgctacgtttcgcggtagtcgcgtacgttcggacggacggactaaaagtagagtacaaacgactgtcgctgaacactactctgtctcgactcccg

SEQ ID NO: 304985 - DNA, 590 bp, Homo sapiens
  misc_feature: GZ8MTXP02FXBVO.10.71.G05.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagagtgttcgctacttcggttaggggtgtatcaacataaatccggcaggctccaggctccnatctttgatgtctttcaacgcgggcccctggccgtcccgaggctaggttcaggtggcaggtgggtctagggactagtaccttcnctctacacatcagcagcctagacgctagaacgtattttgacttagtttacttactgtacagtcgagcgtgtcctacggtttcgggacggtaggtcgccgttacggttcgggacggaacgggaacctaaaagtacgggaaacgttaacgaaaacggtaacgtgggtacgacgttacggaaccgaacctagtccgttacgtttacctactacgtttcccg

SEQ ID NO: 304986 - DNA, 589 bp, Homo sapiens
  misc_feature: GZ8MTXP02FUB5O.10.71.G05.1.454.CMB.2.raw
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttagggtgtatcaacataaanccgcaggctccagctcctcatctttgatgtctttacaacgcgggcccctgggccgtcccgaggctaggttcaggtggctaggtcgggtcgtggggacagtaccttcactctcacatcagcagcctagacgctagaagtatttgcttagtttattactagtcagcagtcgtcgccgtacgttcgggcggtaggtcgtccgtacgttccgggacgggtaacgggaaacctaaaagtacggaacggtaacgaaaacggtaacgtacggtacggcgtacggaacctaaccgtacgttaccgtcgttaccttactacgtttcccg

SEQ ID NO: 304987 - DNA, 539 bp, Homo sapiens
  misc_feature: GZ8MTXP02JGJBE.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctcctgttctgcgtctggattcatctttagtaatctggcatgtcctgggtccgccaggttccaggccagggctggaatgggtgccagatatacatatgatgaacagtaaaatataactataggagactcccttacgaagggccgaattccaccatcctaccaagacgaacaattaccaaagtaaccattgggtagtaatctgacaaatgaacccagcctagagacgccggaaggacctacgggttagtttattacgtggtagggaataactcctaaggtcggactaac

SEQ ID NO: 304988 - DNA, 629 bp, Homo sapiens
  misc_feature: GZ8MTXP02JRS15.10.71.G05.1.454.CMB.2.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacgttcggttaggggtgtatcaacataaactccggcaggcctcccgaggcctcctcattctttgatgtctttacaacgcggcccctggcctcccgaggcaggttcaggtggctagggtcggtcgtgggactaggacttcgcctcgtacaccgatacacgcacgcctagacgtctagtaaagttntttagcttaagtttacttacgtagtacaaggtctacgtcggttcgtcccttacgggttccggggacggtagggttacgtccgttacggttccggggacggtaacgggaaaccctaaaaggtacggaacggtaacgaaaacggtacgtacggtacggtctacgaacctaccgtacgttccgtacgttccttacgtactttaccccg

SEQ ID NO: 304989 - DNA, 556 bp, Homo sapiens
  misc_feature: GZ8MTXP02JVW7L.10.71.G05.1.454.CMB.2.raw
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatcttagtaatctggcatgtcctgggtccnccaggttccagggcccacgggctgggaagtggggtgccagatatacaatatgatgaactaagtaaaatataactatagganacctccttacgaacgggcccgattccaaccatacctacccagaacgacaaacttaccaaagaactatagggtatatacgtagacaaagtcgaaccagcctagacgacgaccggaggacgtacggggtatttacgtacgtggtaggaagaaactccgtaaggtggactaacg

SEQ ID NO: 304990 - DNA, 601 bp, Homo sapiens
  misc_feature: GZ8MTXP02IL6CB.10.71.G05.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtcctgagctctcctgttctgcgtctggattcattcttagtaatctggcatgtccgtcggggtcccnccgtaggttccacgggcccgacggggtctggaagtggggtggccgagatataacaatangatgaactaaagtaaaatataactaagtggaagtacctttaccgttacgaaacgggtcccgtaattaccaccctaatcctacccaagaagaacctaaacttaccaaagaactagtcggtagtaatcgtagtacaaaatcgaaccagtacctagaacgcggaccggaaggaccgtacggggttatttacgttacgtaaggttacgggaagtaaaacgtccgtaaggtcgacgtaacg

SEQ ID NO: 304991 - DNA, 675 bp, Homo sapiens
  misc_feature: GZ8MTXP02ISISU.10.71.G05.1.454.CMB.2.raw
  modified_base (255)..(255): a, c, t, g, unknown or other
  misc_feature (255)..(255): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcggtggtccggcgtgggggtcctgagctctcctgttcngcgtctggattcattctttagtaaatctggctatgtccgtggtccgcaggttccaggcccacgggctaggagtgggtgcaagatataaccaatanagatanaactaaagtaaatataactaagtagggtaacgtacctaccgtttacgaaacggggtccctaattacccaaccctatacctacccgaaggaacaacctaaattacccaaaagtaaactaagttgggtatttaacaccgttaggaaacctaaaacgttacgaaaccgacgcccttagggaaacgacgaacccgggaagggtaaccggttaaccggggtttagtttttaaaaccgttacggttacggggtaagggggtaaaacttaaaacgttcccgtaaaggttacggacctaaagttcccgtaacgtttaggtttaacgg

SEQ ID NO: 304992 - DNA, 551 bp, Homo sapiens
  misc_feature: GZ8MTXP02I3POG.10.71.G05.1.454.CMB.2.raw
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgtctgcgtctggattcatctttagtaatctggcatgtcctgggtccnccaggttccaggccacgggctggaatgggtggcagatatacaatntgatgacaagtaaaatatactatggagactctacaagggccattcaccatctccagagacaattccaagaacaatggtgtatctgacaaatcgacagcctagagacgacccggtaggaacgacggggttagtttacgttaacgttggtacggggaagtaaacttacccgtaaggtcggtaactacgtaccgaaccgtttcggtaattttcggg

SEQ ID NO: 304993 - DNA, 661 bp, Homo sapiens
  misc_feature: GZ8MTXP02IN78X.10.71.G05.1.454.CMB.2.raw
  modified_base (264)..(264): a, c, t, g, unknown or other
  misc_feature (264)..(264): n is a, c, g, or t
  modified_base (386)..(386): a, c, t, g, unknown or other
  misc_feature (386)..(386): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctggagactctcctgttctgcgtctggnttcattctttaagtaatctggcatcgtccgtgggtcccgccgtaggttcccaggcccacggggctaggaagtggggtgcaagataatacgaatagtagaattagaactaaagttaaaaactntaaacttagtaggactaccttccgttacgaaacggggaccctataccacctactcctacccaagaacgaacctaaagttacccaaagaacctagttacggggttataacttcgtacgaactaaaagtcgaaaccgtacggcccgtaaggacggacggaccgggaacgggtaacggttaaccggggtttagtttaacgtttaacgtacgggttaggggaaaactaaacgttccgtaaggtcgacgtactaccgtaccgttagggtttaacttcggg

SEQ ID NO: 304994 - DNA, 858 bp, Homo sapiens
  misc_feature: GZ8MTXP02HQWLY.10.71.G05.1.454.CMB.2.raw
  modified_base (257)..(257): a, c, t, g, unknown or other
  misc_feature (257)..(257): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtggggtcctgagctctctgtcngcgtctggattcattctttaagtaatctggctagttcgtcccgtggggtcccgaccgtacggttcccgaacgggcccgaacggggtcgtaggggtaagtggggggtacggacccgtaaggaattaactaaaccgtaaagttacgttaggtaatacggtaaaacgtaaaaggtttaaaaaacttacgttaaaaccgttaaaggtttacgggggaaaacgttacccctttaaccccggtttaacgaaaacggggggtacccccgtaaattttaccccgaaacccccgttaattaccccgttaaccccggaaaagggtaaaccgtaaaacccgtaaaacttttaaacccccgaaaaaaggttaaacccctaaggtttacgggggttatttaaacggttacccgttaaggaaacccttaaaaagtccggaaaccccgttaacgggaccccgtttaagggaaaacgggtaccggtacccccggggaaaagggggttaaaccccgttaacggggggtttatttttaaaccgttaaggttaacggggtaaaggggtaaaacgtaaaacccgttaccggtaaacggggtttcggaacccgtttaaaccg

SEQ ID NO: 304995 - DNA, 532 bp, Homo sapiens
  misc_feature: GZ8MTXP02G3NB0.10.71.G05.1.454.CMB.2.raw
  modified_base (202)..(202): a, c, t, g, unknown or other
  misc_feature (202)..(202): n is a, c, g, or t
  modified_base (400)..(400): a, c, t, g, unknown or other
  misc_feature (400)..(400): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgtagggtgtatcaacataaatccggcaggctcccaggctcctcatctttgatgctttcaacacgggcccctggccgtcccaggcaggttcagtggcaggtgggtctggggacagacttcgctctcaccatcagcagacctagacgcctaggaaagtnttttagctagtttattactagtcagcagcgtgcctacgtttcggacggtaggtcgcctacgttcgggacggagggaacctaaaagaggagtacaaagactacggcgctcgaacactatctgtcttcactccg

SEQ ID NO: 304996 - DNA, 575 bp, Homo sapiens
  misc_feature: GZ8MTXP02F60EY.10.71.G05.1.454.CMB.2.raw
  modified_base (303)..(303): a, c, t, g, unknown or other
  misc_feature (303)..(303): n is a, c, g, or t
  modified_base (536)..(536): a, c, t, g, unknown or other
  misc_feature (536)..(536): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggaggcgtgggtccggcgtgggggtccctgagctctcctgttctgcgtctggattcatctttaagtaaatcgtggcatcgtccgtcgggtcccnccgaggttccaggcccgacgggctaggaagtggggtgacagataatacaatatgatagaacaaagttaaaatatactagtaggactacctacctagaacgggcgtaactttaccaacctatcctaccaagacgaacaaacttaccaaaagaactagtggtagtaactctagacaaatcgacagccgtagagacgaccggagaaccgtagggttatttagtacgtggtaggaanaacgttcgtaagtgactactacgtacttaggtacttagg

SEQ ID NO: 304997 - DNA, 654 bp, Homo sapiens
  misc_feature: GZ8MTXP02HKUXK.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccacctctcctgcagggccagtcagagtgtcgctacgtttcggttaggggtgtactacaacataaacgtccggcaggcctcccaggcctcctcattctttgatgtctttacaacgacgggtcccctggccgtacccgaggtctacggttcgaggtcggacgtacgggtgggtcgtggggaactagtacctttcacctcctacaccctagtcacgccacggaccctaggacgtccttaggaagttagttttcgaacttagtttattactgttacagtactagcgttgccttaccggtttcgggacggtacggtcgacccgttacggtttccggggacggggtaaacgggaaaccctaaaaaggtacgggaaacggtaaacgtaaaacgtaaacggtcggtacggtacgtgaacctacgtacttcgtacgttccttacgtacctttccccg

SEQ ID NO: 304998 - DNA, 558 bp, Homo sapiens
  misc_feature: GZ8MTXP02FSRQC.10.71.G05.1.454.CMB.2.raw
  modified_base (254)..(254): a, c, t, g, unknown or other
  misc_feature (254)..(254): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagagactcaccatggagtttgggctgagcttgggttttcctcgttgcttcttttaagagatgtccagtgtcagatgcagatggtggagtcgtgggggaggcgtggtccggcgtgggggtccctgagctctctgttcngcgtctggattcattcttagtaaatctggcatgtcctgggtccgccaggttccaggccacggggctgggaatggggtggcagatataccaatangatgaacaagtaaatntactatggatactccttcaaacggggtccgattcaaccatctaccagaanacaattacccaagaaacatgggtactatctagacaaagtcgaacagcctagagacgccggaacggacgtacggggttatttaacttacgtaggttagggaataaaacgtccgtaagtcggacattaccgaccgttggtttaacg

SEQ ID NO: 304999 - DNA, 531 bp, Homo sapiens
  misc_feature: GZ8MTXP02G27WB.10.71.G05.1.454.CMB.2.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattcttagtaaatctggcatgtcctgggtcccncaggttccaggccacgggctggatggggtgccagatanacaatangntgaacagtaaaatntactanganctctacaaggccattcacatctaccagagacaattaccaaagaacagtggtataatctagacaaatcgaaccagcctagacgacgacccgaaggacgtacggggttagtttaagttacgtggttagggaacgtaaactccgtagtacggactaacg

SEQ ID NO: 305000 - DNA, 573 bp, Homo sapiens
  misc_feature: GZ8MTXP02ITK04.10.71.G05.1.454.CMB.2.raw
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (499)..(499): a, c, t, g, unknown or other
  misc_feature (499)..(499): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaatctggcatgtcctgggtccnccgaggttccaggcccacgggctggaatggggtgcagtatatacaatatgatgaacaagttaaaatntactatggatactcctacgaagggccctattccacctatctaccagacgaactaaattaccaagaactagtaggttagtattcgtagacaaatcgaaccagtccgtagagacgccgaaggtaccgtacggggtttntttaacgtacgtgggtagggaacgtaacttccgtaagttcggactactaccgtaccgttaggtttactttcggg

SEQ ID NO: 305001 - DNA, 659 bp, Homo sapiens
  misc_feature: GZ8MTXP02FKS9S.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctgagctctcctgttctgcgtctggattcatcttagtaaatctggcatgtcctgggtcccgccgtaggttccaggccacgggctggaagtggggtgcagatatacaatatgatgaactaagtaaaatataactagtaggaacgtacttccgttacgaaacggggtcccgtatttacccaaccactcctacccagaacgtaacaaactttacccaaaagaaacctaagttagggttagttaacgttacgttaggaacctaaaaaagttccggaaaccacgtacccgtaaggaacggaacgacccgggaaggtaacgtaaccgggggtttagttttaaacgttaacgttagggtacggggtaaaagtaaacgttaccgtaaaggtcggactaacgttactaacccggttaggttaacgtttcggg

SEQ ID NO: 305002 - DNA, 582 bp, Homo sapiens
  misc_feature: GZ8MTXP02JW4IV.10.71.G05.1.454.CMB.2.raw
tcagcatagtagtgcacgaccggtgctcgatttagtgtcgtcgcaagagagagggggggagaggagccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcatcttagtaaatctggcatgtccgtgggtccgccaggttccaggccacggggctgggaactggggtggcagactataccgaatatgattgaacaagtaaactataactagtagacactccttacgaacggggtcctaatttcaacctatacctaccaagagaacaaagttcccaaagaaacagttcggtagtatacgtagacaaatagaccaagcctagaacgagacccggaggaccgtaggggttacgtttagttacgtgggttacgggtaagaaacttccgtaggtacggactaactcgtaaccgttggtttacg

SEQ ID NO: 305003 - DNA, 601 bp, Homo sapiens
  misc_feature: GZ8MTXP02JIPQF.10.71.G05.1.454.CMB.2.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaangccaccctctcctgcagggccagtcagagtgttcgctacttcggttaggggtgtatcaacataaagtccggccaggcctcccaggcctcctnatctttgatgtctttcaacgcggcccctggccgtcccaggcctaggtcagtggcaggtggtcgtggacngacttcnctcacacatcagcagcctagacgctagaagttactttgactagtttattactgtcagctaggtcgttcgacccgttacgtttccgggcggtacggttcgtacccgttacggtttccggggacgggtaacgggaaaccgtaaaagtacggaaggtaaccgaaaacggtaacgtcgggttacggacttacggaaccgtaccaacgttcgttacgttaccttactaccgtttcccc

SEQ ID NO: 305004 - DNA, 605 bp, Homo sapiens
  misc_feature: GZ8MTXP02GKHS7.10.71.G05.1.454.CMB.2.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaancgccaccctctcctgcagggccagtcagagtgttcgctacgttcggttagggtgtatcaaacataaacgtccggccaggcctcccgaggtcctcctnattctttgatgtctttacaacgcggcccctggcctcccgaggtctaggttcaggtcggctaggtggggtctggggacagtacttcactcacaccatcagcacgacctagacgcctagaagttgtttgcttagtttaattacgtgtcagtcaggtcgtgcctacggttcgggcgtaggtcgaccgttacggttcgggacggtaagggaaacctaaaagtacgggaaggtaaccgaaaacggtacgtaggtacggccttacggcctaacccgtagttccgttacggttaccttacgtacctttccccg

SEQ ID NO: 305005 - DNA, 546 bp, Homo sapiens
  misc_feature: GZ8MTXP02IZXW5.10.71.G05.1.454.CMB.2.raw
  modified_base (423)..(423): a, c, t, g, unknown or other
  misc_feature (423)..(423): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcattcttagtaaatctggcatgtccgtgggtcccgccgtaggttccaggcccacggggtctggaagtggggtggcagatatacaatatgatgacaagtaaaatatactatgggatactccttagaacgggccaattacacctatcctacagaanacattaccaaagaacagtgtagtatctagacaaagtcgaacagcctagagacggacgaggacgtacgggttatttagtacgtaggtaggaagtaaacgtcgtaaggcgtactagtacctacgg

SEQ ID NO: 305006 - DNA, 558 bp, Homo sapiens
  misc_feature: GZ8MTXP02HWASX.10.71.G05.1.454.CMB.2.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaancgccacctctctgcagggccagtcagtagtgtcgctacgtttcggtagggtgtatacaacaataacnccggcaggctccagctctcatcttgatgtctttcaacgacggcccctggccgtccaggcaggttcgagtggctaggtggtcagggacagtactcnctctcaccgntacgagcacgcctagacgtacctagaagttattttcgacgttagtttattacgtgtacagtcaggtcgttacgccttacggttcggacggtaggtccgtcgtacggttcggacgaaggaaacaaagtacgagacaaaagcgtagtcgacgtcgaactcctaatctacgtcctctacgttccccg

SEQ ID NO: 305007 - DNA, 569 bp, Homo sapiens
  misc_feature: GZ8MTXP02G11VN.10.71.G05.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgtggtttcgcgtaggctctttaagagatgtccagtgtcagatgcagatggtgagtgtgggggagcgtggtccggccgtgggggtccctgagctctcctgttctgcgtntggatcntnttataatntggctntcgtcgtcggtccgcgtcgtcgacgcgcggngtggaggtggtggagagatatataatatagagtagaactaaataaatataagtagtagtacgtactacgtacgacgtacgtactactactactactacgacgacgtaactaactaactaaacgaacgtagtagtagtagtactagacaacgacgacgacgacgacgagacgacgaacggtacggtacggttagttacgttacgtacggtaggtaacgtaacgtacgtaagtacgtacgtacgtacgtacgtacgttacgtacg

SEQ ID NO: 305008 - DNA, 623 bp, Homo sapiens
  misc_feature: GZ8MTXP02IOAER.10.71.G05.1.454.CMB.2.raw
  modified_base (254)..(254): a, c, t, g, unknown or other
  misc_feature (254)..(254): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtggtttcgcgtagctctttaagagatgtcagtgtcagatgcagatggtggagtgtgggggagcgtggtccgcgtgggggtcctgagctctcctgttccgngcgtcgtgtattctattacgtttaagtaatcgtgctagttcgtccgtcgggtcccgccgtacggtccgacgggccgacggtcgtaggtagtgggtacgaccgtaagtaactaataactaatagtagtagtaagtaaacgtaaagtaaaataaataacgtaagtacgtaacgtacgtaccgtacgtaacggtacgtactactacctactactaccgacgtaacgtaaactaactaacaaacgtaaactagtaggtagtatactacgtaacgtaacgtacgacgacgacgtacgacgacgacggacgtaacggtacggttacgttagttacgtaaggtaggtaacgtaacgtacgtacgtacgtacgtacg

SEQ ID NO: 305009 - DNA, 728 bp, Homo sapiens
  misc_feature: GZ8MTXP02GD45J.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcattctttaagtaaatcgtggctagttcgtccgtcggggtcccgccgtacgggttcccacgggcccgaacggggctaggggaacgtgggggtggcccaaggattataactaatagtagatagaaactaaagtaaaatattaactaagtagggaacgtaccttacccgttacgaaacgggggtccctaagtttacccaaccgtaacttcccgtaccgaaagacgtaaacctaaacgttacccaaaaggtaacctaagttaggggttactaacttcgtaggtaaccctaaaagttccgggaaaccctaacggtacccgtaaggggaaaccggaaccggtaccccggggtaaagggtaaaccgggttaacccgggggttttattttaaaccgttaccggttaaggggtaggggtaaaacgtaaaaccgtttcccgtaaaggggttccggaactttaacg

SEQ ID NO: 305010 - DNA, 767 bp, Homo sapiens
  misc_feature: GZ8MTXP02G50S7.10.71.G05.1.454.CMB.2.raw
  modified_base (305)..(305): a, c, t, g, unknown or other
  misc_feature (305)..(305): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgtctgcgtctggattcatctttagtaatctggcatgtcctgggtcccnccaggttccagggcccacgggctggaatggggtgccagatatacaatatgatgaacaagtaaaatataactatagggaagtaccttacccgtttacgaaacgggggtcccgtaatttacccaacccctattaccctaccccgaagaacgtaaaacctaaactttaccccgaaaaaggtaaacctaagttagggggttaacgttaaacttacccgtttaagggaaaccctaaaaaagtttaccgggtaaaacccccgaaaagggtaccccccgtttaaggggaaaaccggggtaaaccgggtaccccccgggggaaaagggggtaaacccgttaaacccgggggggggttttaactttttttaaaagtttttaaacccgggttaaggggttaaacggggggtaaaacgttaaaaaacgtttccccggtttaaaacggggttcggggaaaccttttaaacccgg

SEQ ID NO: 305011 - DNA, 729 bp, Homo sapiens
  misc_feature: GZ8MTXP02H2WWD.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatgggtggagtcgtgggggagcgtggtccggcgtgggggtccctgagctctcctgttctgcgtctggattcattctttagtaaatctggctagttcgtccgtcggggtcccgccgtacgggttcccagggcccgtacggggctagggaagtggggtgccgagatataacaatagtagatagaaactaaagtaaaattataactattagggaactacctacccgttacgaacggggtaccctaactttaccaaccctattccctaacccgaagaacgtaaacctaaactttaaaccccaaaaggtaaacctaagttgggttaacgttaacttaccgtaggaacctaaaaagttcggaaacccgtaacggtacccgttagggaaacggtaccggaacccggggaaacggggtaaaccggtttaaccgggggtttagtttttaaaccgtttaaccgggttaaggggtttaacgggggaaaacgtaaaacggtttaccccggttaaggggttacggtacccttaaaccgg

SEQ ID NO: 305012 - DNA, 734 bp, Homo sapiens
  misc_feature: GZ8MTXP02IK0RW.10.71.G05.1.454.CMB.2.raw
  modified_base (310)..(310): a, c, t, g, unknown or other
  misc_feature (310)..(310): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggtttcctcgttgcttcttttaagagatgtccagtgtcagatgcagatggtggagtcgtgggggagcggtggccggcgtggggtcctgagctctcctgttctgcgtctggtattcattacttagtaatcgtggctagtcgtccgtcggtcccncgtacgtccgacggccgacggtcgtaggaggtggggtgaccgaagtataactaacgtaattagtagagtaagaaacgtaaaagttaaaatacgttaaacgtagtaacggaacgtaccgttacccgttacggaaaccgggtcctaattacccaaccttactaccgtacgaaagaacgtaaccttaaaccgttaaccgaaaagtacgttagttcgggtaaattcgttacgtaacgtaacttaaaacggccgtaaaccgtacgacccggtaaagggaaaccgggaccgggaaaccccggggtaaaagggttaccggggtttaaacccgggggttttaatttttaaccggtaaacggggttcgggttaaaagggtaaaaccgttacgttaaaacccgggtttgggtaaccggtaccgtttaaaaccgg

SEQ ID NO: 305013 - DNA, 617 bp, Homo sapiens
  misc_feature: GZ8MTXP02JMDAK.10.71.G05.1.454.CMB.2.raw
  modified_base (377)..(377): a, c, t, g, unknown or other
  misc_feature (377)..(377): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgagactctcctgttctgcgtctggattcattcttagtaaatctggcatgtcctggtccgcaggttccaggccacgggctggaagtggggtgcagactatacaatatgatgacaagtaaaatatactagtagganacttccttgaaacggtccgattcaaccctatcctaccaagacgaactaagttacccaaaggaaaccagttgtagtaatcgtagaacaaaacttggaaccctaggacccgtagaacggtaacggaccggaaagggaaacccgtagggggtttaacttttaaacgttaccggttaggggttacggggtaaagtaaaaacgttcccggtaaggttacgggacctaacggtaccttaaacccgg

SEQ ID NO: 305014 - DNA, 552 bp, Homo sapiens
  misc_feature: GZ8MTXP02H0V4P.10.71.G05.1.454.CMB.2.raw
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggaggcgtggtccggcgtgggggtcctgagactctcctgttcngcgtctggattcattctttaagtaaatcgtggcatgtccgtgggtcccnctaggtccaggccacgggctggaatgggtgcagatatacaatatgatagacaagttaaaatntaactataggatactactagaaagggcctataccacatccacagacgaacaattaccaagaactatggtatatctagacaaatacgacacgtaccgagagacgacgacggaacgacggttagttacgttagtaggtaggaagtaaagtaccgtaagtaggtacactactaccgtacgttagtttagg

SEQ ID NO: 305015 - DNA, 531 bp, Homo sapiens
  misc_feature: GZ8MTXP02HFBRH.10.71.G05.1.454.CMB.2.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaaggggaaangccaccctctcctgcagggccagtcagagtgttcgcactttcggttaggggtgtatcaacataaatccggcaggctccaggctcctcatctttgatgtctttcaacgaggcccctggcctcccgaggcaggttcaggtggcagtgggtctggggacagccttcnctctcaccatcagcagcctagcgctagagtatttgactagtttattacgtgtacagctagcgtcgcctacgtttcggcggacggtcgccgtacgttcggacggtagggaacctaaaagtagaggtacaaacgacgtagtcgactgcacgatctgtctacactcc

SEQ ID NO: 305016 - DNA, 592 bp, Homo sapiens
  misc_feature: GZ8MTXP02GV2ND.10.71.G05.1.454.CMB.2.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (420)..(420): a, c, t, g, unknown or other
  misc_feature (420)..(420): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgccgtctttgtctccgaggggaaancgccacctctcctgcagggccagtcagagtgttcgctacttcgttagggtgtatcaacataatcgcaggctccgagctcnatcttgatgtctttacacgcggccctggcctccaggctaggtcagtgcaggtcggtntcggacagtctcactcacactatcancacgcctagcncctagacgttagtttgtacttagtttattacgtgtacagtacnggtacgtcgtaccgtacgtttacgggcggtacggtcgtaccgtacggtttcgggacgggtaacggaaaccgtaaaagtacgggtaacggtaacgaaaacgtacgtaggtacggcgttaacggacctaaccgtaacttcgtacggttccttacgtaccgtttaccttaccccg

SEQ ID NO: 305017 - DNA, 580 bp, Homo sapiens
  misc_feature: GZ8MTXP02G5TQ8.10.71.G05.1.454.CMB.2.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacgttcggttagggtgtatcaactataaatccggcaggctcccaggctcctcatctttgatgtctttcaacgcggcccctgggcccgtcccgaggtcacgggttcaggtggcaggtgggtatggggacnggtacttcnctctcaccgtatcgagcacgcctagacgcctagaagtntttgactagtttatactgtcagcagcgtgcccgttacgtttcgggcggtacggtcgacccgtagtttccgggacggaacgggaactaaaaagtggaacgtacgaaaacgtaacgtgtacggactacggaactacgtattccgtacgtcttacgactttccccg

SEQ ID NO: 305018 - DNA, 619 bp, Homo sapiens
  misc_feature: GZ8MTXP02GSE7P.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagctctcctgttctgcgtctggattcattcttagtaaatctggcatgtcctgggtcccgcctaggttcccagggcccacggggctgggaagtggggtggccagatatacaatatgatgaactaagtaaaatataactagtggagtactccttacgaaacggggcctaattccaccctattcctacccaagtacgaaacctaaactttacccgaaaagaaacctaagttagggtagttaactaccttaggaacctaaaacgtcgaaacctagaccctaggaacggacggacccggaaaggaccgtaccggggttagttttaacgttaacggtggtaggggaaagtaaaacttccgtaaggtcggactaacg

SEQ ID NO: 305019 - DNA, 535 bp, Homo sapiens
  misc_feature: GZ8MTXP02F2BWY.10.71.G05.1.454.CMB.2.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcggttagggtggtatcaacataaatccggcaggctcccaggctcctcatctttgatgctttcaacngggcccctggcctcccaggcaggttcagtggcaggtgggtctggggacagacttcnctctcaccatcagcagcctagacgcctagaagtnttttgctagtttattactgtcagtcagtcgtgcctacgtttcggcggtaggtcgcccgtacgtttcgggacggagggaaccaaaagtaggaggtacaaacgactgtacgctgcacgatctagtctacacttccc

SEQ ID NO: 305020 - DNA, 726 bp, Homo sapiens
  misc_feature: GZ8MTXP02IBFDS.10.71.G05.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctcgaggggaaanacgccacctctcctgcagggccagtcagagtgttcgctacgttcggttaggggtgtatacaactataaactccggaccaggcctaccccgaggcctcctctatctttgattgtctttacaacgtacggcccctggccgtccaggtcaggttcaggtcggcagggtggtcgtgggactagtaccttcgactcctacacccgtatcgacgcacgacccgtagacgtcctagtaaacgtagttttacgtacgttagttttaacttacgttacgttacgacggtaccgtacggtccggttacggtacccgttacgggttttccgggggaccggggtaacggggttccggtacccggttaccggttttaccgggggaaccggggtaaacgggggtaaaacccgtaaaaacggtaaacggggtaaacgggttaaaaccgtaaaaccgggtaaaacggttcggtaacgggtaccgtacggaacccgtaacctaagttccgttacggtttacctttacgtaacctttccccg

SEQ ID NO: 305021 - DNA, 663 bp, Homo sapiens
  misc_feature: GZ8MTXP02JEC2K.10.71.G05.1.454.CMB.2.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
tcagcatagtagtgcacgaccggtgctcgatttagtgtcgtcgcaagagagagggggaggaactgctcagttaggacccaggggaaccatggaagccccagctcagcttctcttcctcctgctactctggctcccagacaccaccggagaaattgtgttgacacagtctccagccacgctgtcttttgctccgaaggggaaanacgccaccctctcctgcagggccagtcaggagtgttcgctactttcggttagggtgttatcaaactataaactccggcaggcctccgaggcctcctcattctttgatgtcctttacaacgcgggcccctggccgtcccaggctaggttcaggtggctaggtcgggtctggggacacgtacttcactcgtcaacctntcagcagcctagacgcgtagaagtatttgacttagtttacttacgtgtacagtcgtacgtcgtacgtaccgttacgtttacggggacgggttaacggtcgtacccggttacggtttacggggaccggggtaaacgggaaaaccgtaaaaagtacgggtaaacggttaaaccgaaaacggtaaacgttacgggtacggtaccgttacggaccgtaaccgtaacgttccgttacgttacctttactaccgtttcccgtttaccccg

SEQ ID NO: 305022 - DNA, 662 bp, Homo sapiens
  misc_feature: GZ8MTXP02JLHDE.10.71.G05.1.454.CMB.2.raw
  modified_base (259)..(259): a, c, t, g, unknown or other
  misc_feature (259)..(259): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtccctgagactctcctgttcngcgtctggattcattctttaagtaaatcgtggctagttcgtccgtcgggtcccgccgtacggttccacgggcccgacggggctgggaagtggggtgaccgagatataacgaatatagtatagaactaaagttaaaataattaacgtaagtaggggtaaactactacccgtttacgaaaacgggggtccctaattacccaacctacttacctaccaagaacgaaactaaacgttaacccaaaagtaacctagttagggtaactactacgttacgaaactaaacgtacgaaccaacgacccgtaggaacggacggacccggtaaacggaccggtacgggtttagtttaaacgtacgtaaggggtacggtaaaagtaaaaccttccgtaaaggtcggtactaaccg

SEQ ID NO: 305023 - DNA, 544 bp, Homo sapiens
  misc_feature: GZ8MTXP02GZ7X2.10.71.G05.1.454.CMB.2.raw
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgcacttcggttagggtgtatcaacataaatccggccaggctcccaggctcctcatctttgatgctttcaacacggcccctggccgtcccaggctaggttcagtggcaggtgggtctggggacaggtacttcactctcacctatcagcagaccctagacgcctagaacgtntttgactagtttatactgtacagcagcgtgcctagttcggcggtagtcgcctacgttcggacggtaaggaacctaaaagtacggaggtacaaacgtaactggacgctagcgtactatctagttcttacgactttccccg

SEQ ID NO: 305024 - DNA, 670 bp, Homo sapiens
  misc_feature: GZ8MTXP02GIF47.10.71.G05.1.454.CMB.2.raw
  modified_base (268)..(268): a, c, t, g, unknown or other
  misc_feature (268)..(268): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggtttttcctcgttgcttcttttaagagatgtccagtgtcagatgcagatgggtggagtcggtgggggagcggtggtccggcggtcggggtcctgagctctcctgtctgcgtntggtattctattctttaagtaatcgtggctagttcgtccgtcgggtcccgccgtacggttccacgggcccgacgggtcgtagggaagtggggtgacagtactaagtaacaaagttatgagtagaaaacgtaaagttaaaaatacttaaagttagtaagggtactacccttacccgttagaaacggggtcctaacttccaaccctatccctaccgaaagaactaaacctaaacttaaccgaaaacgtaacgtaaagtttcggggtaattaaaccttcgtaacgtaaactaaaacgtcgaaacccgtacgaccgtaggaagaccggaccggaaacggtacgttacgggtttagtttaacgttagtgggaaggtaaacgtaaacgttcgtagtacggtataaccg

SEQ ID NO: 305025 - DNA, 587 bp, Homo sapiens
  misc_feature: GZ8MTXP02GKYDM.10.71.G05.1.454.CMB.2.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcgtggtccggcgtgggggtccctgagctctcctgttctgcgtctggattcattcttaagtaaatctggctagtcgtccgtcgggtccnccgaggttccagggccacggggctagggaacgtggggtgcagactatacaatangattgactaagtaaaatctaactagtaggtaacacttccttacgaaacggggccctaattccaacctatcctacagaagtacaattaccgaaagaacngttaggtntactctagactaaaatcgaaccagcctaggaacgaggacccggaggtaccgtacggggttatttaacgtacgtggtaaggaagtaaacttaccggtagtccggactacgtacgtaacgg

SEQ ID NO: 305026 - DNA, 575 bp, Homo sapiens
  misc_feature: GZ8MTXP02I746W.10.71.G05.1.454.CMB.2.raw
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggaggcgtggtccggcgtgggggtccctgagctctctgttctgcgtctggattcattcttaagtaaatctggctatgtccgtggtccaccgaggttcccaggcccgacgggtctagggaagtggggtggcagaatataacctaatatgatggaactaaagtaaatataactagtaggacgtactctacgaagggcctattccactatcctacaganacaactacaaanaacatggtatatctagacaaatcgactagcctagacgacggccgaggacgtacggggttatttaacgttacgtagggtacgggtaagtaaacgtccgtaaggtcggactactaccgaccgttaggtttaacg

SEQ ID NO: 305027 - DNA, 668 bp, Homo sapiens
  misc_feature: GZ8MTXP02IGGQZ.10.71.G05.1.454.CMB.2.raw
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgttgggttttcctcgttgcttcttttaagagtatgtccagtgtcagatgcagtatggtggagtcggtgggggagcggtggtccggcgtggggtcctgagctctctgttcngcgtctgtntcattcttagaatcgtggctagtcggtccgtgggtcccncgtacggtccgacggccgagggcgtaggagtggggtgaccaagtataataactaatagtagagtagaaactaaagttaaaatatacgtagaggtaacgtcctaccgtacggaacgggtaccctaattaccaaccgtacttccccgtaacgacgtaaacggtaaacctaaaccgtttaaaccgaaaaggtaaccttaggttcggggttaaacttactaccgttaaggaaccctaaaagtccggaaccgtacgacccgtaggaacggtacggaccggtaagggtaaaccgttcggggtttagtttaacgtacggttgggtaacggtaaacggtacttacggtaggttacgactttaccg

SEQ ID NO: 305028 - DNA, 695 bp, Homo sapiens
  misc_feature: GZ8MTXP02JJXL3.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagactctcctgttctgcgtctggattcattctttaagtaatcgtggctagtcgtccgtcgggtcccgccgtacgggttcccgacgggtcccgaacgggtcgtaggggaagtgggggtcggcccgtaaggtaattaataacgtaaattaagtaggtataacggtaaactaaaaggttaaaaatacttaaacgttaaagtacggggtaacgtaccgttacccgtttaccgaaacgggggtccctaagtttacccaacctaacttcccttaccgaaagaacgaaactaaacttaacccgaaaagaaccgtagttagggttattaacttacgtacggaactaaacgtcgaacctaacgtcccgtaggacggacggaccggggacgtaacgggttacggttacgtttacgtaggtaagtagggtaaactaacgtccgtaggttacgactaaccg

SEQ ID NO: 305029 - DNA, 585 bp, Homo sapiens
  misc_feature: GZ8MTXP02HFE71.10.71.G05.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacgttcggttaggggtgtatcaacataaatccggccaggctcccaggctccncatctttgatgctttcaacacgggcccctggccgtcccaggcctagggttcaggtggcagtggggtctgggacagtacttcactcncacatcagcagctagagcctgaagtatttgctagtttattactgtcagcagcgtgcctacgttcggcggtaggtcgccgtacgtttcgggacgggtaacgggaaacgaaaagtaggtacggtaaaccgaaaacggtaaaccgttgggtacgtacgtacgaacccgtaccgtaacttcgttacgttacctttaccgtactttcccccg

SEQ ID NO: 305030 - DNA, 595 bp, Homo sapiens
  misc_feature: GZ8MTXP02HMICO.10.71.G05.1.454.CMB.2.raw
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctcctgttcngcgtctggnttcattcttagtaatctgcatgtcctggtccnctaggtccagggccacggctaggatgggtgcagatatacaatntgatgaaacaagttaaaaatataactagtaggaagtaccttaccgttacgaacggccgtattaccaaccatcctacagaacgaactaacttaccgaaaagtaactagtaggtagttactacgttagactaaaagtcggaaccagtaccctagggaaacgaggaacccggtaagggtaacccgtacgggggttattttaacgtaacggttgggtacggtaaagtaaacgtccgtagggtacggtactaacg

SEQ ID NO: 305031 - DNA, 538 bp, Homo sapiens
  misc_feature: GZ8MTXP02FKCDI.10.71.G05.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccagggaaanagccaccctntcctgcagggccagtcagagtgttcgcacttcgttagggngtatcaacataaatccggccaggctcccaggctcctcatctttgatgctttcaacaggcccctggcgtcccaggcaggttcagtggcagtgggtctgggacagacttcnctctcaccatcagcagccctagacgcctagaacgtattttgctagtttattactgtcagcagtcgtgcctacgtttcggcggtaggtcgcccgtacgttcggacggtacgggaaccaaaacgtaggacggtacaaaacgaacgtgtacggctgaacaccactctagtcttcacttcccg

SEQ ID NO: 305032 - DNA, 564 bp, Homo sapiens
  misc_feature: GZ8MTXP02G4MK5.10.71.G05.1.454.CMB.2.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacgttcggttagggtgtatcaacataaatccggcaggctcccaggctcctcatctttgatgtctttacaacgacgggcccctggccgtcccgaggcctaggttcaggtggcaggtggggtctggggacagtacttcnctcncaccatcagcagcctagacgcctagaagtattttgacttagtttattactgtcagcagcgtagcctacgtttcggcggaggttcgcccgtacggttcggacggtaaggggaaccaaaagtaggaaacggtacaaaacgaacgttggtacgctacgaaccactacttctgtctacactttcccg

SEQ ID NO: 305033 - DNA, 622 bp, Homo sapiens
  misc_feature: GZ8MTXP02GYXWW.10.71.G05.1.454.CMB.2.raw
  modified_base (203)..(203): a, c, t, g, unknown or other
  misc_feature (203)..(203): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccacctctcctgcagggccagtcagagtgttcgctacgttcggttaggggtgtatcaacataaactccggcaggcctcccgaggcctcctcattctttgattgtcctttacaaacgcgggtcccctggccgtcccaggtccaggttcaggtggctagggtggtctgggacagtacttcncctctcacatcgancagcctagacgctagaagttntttgacttagtttactactgtacagcgagtcgtacgcccttacggttcgggaccgggtaggttcgtacccgtacggtttcggggacggggtaaacggtaaaaccgtaaaaggtacgggtaaacgtaaaccgaaaacggtaaacgttcggacggtactacggaaccgtactacgttaccgtcgtttaccttacgtacctttcccg

SEQ ID NO: 305034 - DNA, 654 bp, Homo sapiens
  misc_feature: GZ8MTXP02HZNET.10.71.G05.1.454.CMB.2.raw
  modified_base (271)..(271): a, c, t, g, unknown or other
  misc_feature (271)..(271): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtcctgagactctcctgttctgcgtctggnttcatctttagtaaatctggcagttcgtcccgtcggggtcccgccgtacgggttcccgacgggccgacggggccgtaggggtaagtggggttcggcccgaagagttataacaaagttatgatagaactaaagtaaaatatactagtcggagtaccttaccgttacgaaacggggtccctaatttaccgaacccctaatcccgtacccgaagtaacgaaacctaaattaccgaaaacggaactaaaggttgggttacgtaaattccgtacggaactaaaacgtcggaaccacgtacccgtagaacggaccgtaccggagggtaccgtacgggttgttttaactaggtggtagggaaacgtacgttaccgtaaggtcggactacg

SEQ ID NO: 305035 - DNA, 647 bp, Homo sapiens
  misc_feature: GZ8MTXP02I58RB.10.71.G05.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (431)..(431): a, c, t, g, unknown or other
  misc_feature (431)..(431): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacgttcggttagggtgtatcaanataaatccggcaggcctcccaggcctcctnatctttgatgtctttcaacgtacgggcccctggccgtcccgaggcctaggttcaggtggcaggtcgggtctggggactaggtaccttcgacttcctccaacctatccagcctacgcccgtagacgccgtagaaagttnttttaggacttaagtttacttactgtacgtagactaggcgttcgcccttacggtttcggacgggtaggttcgaccgttaccggtttccgggacgggtaacgggtaaaccctaaaaggtacggaacggtaaaccgtaaaacggtaaacgttcgggtacggtacgttacgaaccgtaccgtaacttccgtacgtttacctttacgtacgtttcccccg

SEQ ID NO: 305036 - DNA, 617 bp, Homo sapiens
  misc_feature: GZ8MTXP02FPDE5.10.71.G05.1.454.CMB.2.raw
  modified_base (249)..(249): a, c, t, g, unknown or other
  misc_feature (249)..(249): n is a, c, g, or t
  modified_base (535)..(535): a, c, t, g, unknown or other
  misc_feature (535)..(535): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggaggcgtggtccggcgtgggggtcccngacgctctcctgttctgcgtctggtattcattcttagtaaatctggcagtcgtccgtgggtcccgccgtacgggttccacgggtcccgacggggtctagggaagtcggggtggacccaagtataacgtaactaaatatgtataggaaactaaaaggttaaaaattataaacgtagtacgggtaacgtaccttacccgttaggaaacgggtcctaatttaccacctatcctaccgaagaactaactaaactaccaaagaactagttaggtatactctagaacaagtnaaccgagtctagagacgcgaaggtaccgtacggtttagttacgttagtaaggtaggtaaactaaacgtcgttagcggactac

SEQ ID NO: 305037 - DNA, 742 bp, Homo sapiens
  misc_feature: GZ8MTXP02J3UDX.10.71.G05.1.454.CMB.2.raw
  modified_base (270)..(270): a, c, t, g, unknown or other
  misc_feature (270)..(270): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagtcttgggtttttcctcgttgcttcttttaagagtatgtccagtgtcagatgcagagtggtggagtcgtggggagcggtcggtccggccgtgggggtcctggagctctcctgtctgcgtcnggtattcatttacttagtaatctggctagttcggtcccgtgggtcccgtccgacggttcccgacgggcccgtacggggtctaggggtaaacgtggggtacgacaaggtactaacgtaacaagttattgaagttagaactaaaagttaaaaacttatacgttaagtacgggtaaacttaccccttaccgttaaccgaaacggggtaccctaactttaccccaacctacgttaccctaccgaaagtaaacccccccgtaaataaacctttaaccccgaaaagaaacccgtgtttagggttactaacgttctaacggaacctaaagaccgaaaccccgagtacccgtaagggaacggtaccggacccggtaagggtaccggttaaccggggttttattttaaccggtacgttaggttaacgggggaaactaaaccgttccgtaaggttccggaccttaacgtcccgtttaaccgg

SEQ ID NO: 305038 - DNA, 579 bp, Homo sapiens
  misc_feature: GZ8MTXP02GS8KP.10.71.G05.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccacctctcctgcagggccagtcagagtgttcgctactttcggttaggggtgtatcaaacataaactccggcaggcctcccgaggctcctnatctttgatgtctttcaacgcggcccctggcctcccaggcaggttcagtggcaggtgggtctgggacagtacttcgctctcaccatccagcagcctagcgcctagaagtatttgcttaagtttactacgtgtacagcagtcgtcgaccgtacgttcggcggtagtcgccgtacgttcgggacggaacgggaacctaaaaggtcggaacggttaacgaaaacggtacgttcggtacggaccgttcggaaccaccgtacgttcgtacgttcttaccgactttcccg

SEQ ID NO: 305039 - DNA, 636 bp, Homo sapiens
  misc_feature: GZ8MTXP02G1MCP.10.71.G05.1.454.CMB.2.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctctgttctgcgtctggattcattctttaagtaatctggctagtgtcccgtggggtcccnccgtagggttcccaggcccgacggggctgggaagtggggtgcagtatatacaatatgatgaactaaagtaaaatntaactagtaggaacgtaccttccgttacgaaacggggtccctaattcccaacctacttcctacccgaagaaacgtaacctaaaacttaccccaaaagaacctaagttgggttagtacttacgtagaacctaaagtccgaaccacggcctaggacgacggaccggaggtaacgtacggggtttatttaacgttacggaggttagggaaactaacgtaccgtaaggtcggactactccgtacgttggttaacgtttcggg

SEQ ID NO: 305040 - DNA, 548 bp, Homo sapiens
  misc_feature: GZ8MTXP02G2OQ7.10.71.G05.1.454.CMB.2.raw
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (467)..(467): a, c, t, g, unknown or other
  misc_feature (467)..(467): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatctttagtaatctggcatgtcctggggtcccncctagggttccagggtccacggggctagggatggggtggccagatatacaatatgntgaacaagtaaaatatactagtggagactctacgaagggccattcgacatcctacagagaacagttacccaaagtaacagtagggtatactctagactaaaagtnaacccgagcctaggacgagccgaggaccgaggggttacttaagtacgtgagggtaagaaacgtcctaggtacggactaacg

SEQ ID NO: 305041 - DNA, 586 bp, Homo sapiens
  misc_feature: GZ8MTXP02IL8X5.10.71.G05.1.454.CMB.2.raw
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtcccngagctctcctgttctgcgtctggatcattcttagtaatctggcatgtccgtgggtcccgctacggttcccacgggcccgacgggctagggaagtggggtgccagataagtacaatatgatgaacaaagttaaaatntaactagtaggaacgtactccttacgaacgggacctaagttccaacctatccgtaccagagaaacaaacttaaccaaagtaaactagtagggtattactactagaactaaagtcgaacctagcccgtagacggacgacggaacggacgtaccgggttatttagttacgtggtagggaacgtaaacgtccgtaggttcggactaacg

SEQ ID NO: 305042 - DNA, 581 bp, Homo sapiens
  misc_feature: GZ8MTXP02GPKTU.10.71.G05.1.454.CMB.2.raw
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccacctctcctgcagggccagtcagagtgttcgcacttcgtagggtgtatcaacataaatccggcaggctcccgaggctcctcatctttgatgtctttcaacacgggcccctggccgtcccgagggcctagggttcaggtggcaggtgggtctgggacagacttcnctctcaccatcagcagcctagacgctagaagtattttgctagtttattactgtcagtcagcgtcgacctacgtttcgggcggtaggtcgccgtacgtttccgggacgggaacggggtaaccaaaagtacgggaacgggtaaccgaaaaccggtacgtacggtacggccttaggaactaccgaacgttcctcggttaccttctacgtttcccg

SEQ ID NO: 305043 - DNA, 674 bp, Homo sapiens
  misc_feature: GZ8MTXP02G9O8O.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggccgtgggggtccctgacgactctcctgttctgcgtctggattcattctttagtaatctggcatcgtccgtgggtcccgccgtaggttcccagggcccgaacggggctagggaagtggggtgccgaagtatataacatatagatgaactaaagtaaaatataactagtgggaacgtaccttaccgttacgaaacggggtcccaatttaccaaccctacgtccctacccaagaacgaaacctaaacttacccgaaaaggtaacctaagttacggggtattaacgtcctaggaacctaaagtaccggaaccctacggcccgtaaggaacggaacggtacccggaaaggggtaaccgtaccgggggtttaagtttaaccgtttaaacggttgggggtaaggtaaaacggtaaaacttcccggttaagggtaccggacttaaccg

SEQ ID NO: 305044 - DNA, 515 bp, Homo sapiens
  misc_feature: GZ8MTXP02IMRIL.10.71.G05.1.454.CMB.2.raw
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgagctctcctgttctgcgtctggattcatctttagtaaatctggcatgtctggtccnccaggttccaggtccacgggctggaatggggtgacagatatacaatatgattnactaagtaaaatatactatagagtactcctanaacgggtcattcaactatcctacagacacattaccaaagaacattcggtatatctagacaaatgaacngaccngagacgccgagacgtaggtatttactacgtgtaggaataagtctagtgctatctacg

SEQ ID NO: 305045 - DNA, 614 bp, Homo sapiens
  misc_feature: GZ8MTXP02HJ1V5.10.71.G05.1.454.CMB.2.raw
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcggtgggtccggccgtgggggtccctgacgctctcctgttctgcgtctggattcattctttaagtaaactctggctattcgtccgtcgggtcccgcctaggttcccacggcccgaggggctagggaatggggtgacagactatacaaattagtanagtagacaaagttaaaaatataacgttagtagggaatacctaccgttacgaaacggtccgtaatcccaacctatcctaccaagaccgaactaacttaccaaagtaactagttacggtatatcagtacaaatacgaccgagcctagaacggacgccggaggaccgtaacgggttagtttaacgttacgttaggtagggaagtaaaccgttacgttaggacggtacctagtacgtaccgg

SEQ ID NO: 305046 - DNA, 583 bp, Homo sapiens
  misc_feature: GZ8MTXP02IOWNB.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagcccaccctctcctgcagggccagtcaggagtgttcgctacttcggttaggggtgtatcaacataaatccggccaggcctcccaggctcctcatcctttgatgtctttcaacgacgggcccctggccgtcccaggctaggttcaggtggcgaggtgggtcgtgggacaggacttcactctcaccatcagcagccctagagcctagaagtattttgactaagtttactactgtcagtcagtcgtgcctacgtttcggcggtaggtcgccgtacgtttcgggacgggtacgggaacctaaaaggtacggaacggtacaaaacggtacgtggacggtacgtagaaccgtaccacgttctacggttccttcgtactttccccg

SEQ ID NO: 305047 - DNA, 625 bp, Homo sapiens
  misc_feature: GZ8MTXP02F0S1U.10.71.G05.1.454.CMB.2.raw
  modified_base (309)..(309): a, c, t, g, unknown or other
  misc_feature (309)..(309): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtgggtccggcgtgggggtcctgagactctctgttctgcgtctggattcattcttagtaaatctggctatgtccgtcggggtcccnccgtaggtttcccagggcccacggggtctagggaagtcggggtggcagtatatacaatatgactgacaagtaaaatatactagtaggacacttaccgttagaaacggccgtaattccaaccctatcctacccgaaggaacaacctaaacttacccaaaggtaaacctaagttgggtacttactactacgaactaaattcggaacctagccctaggacgacggtacccgaggtacccgtagggttagtttaacgttaccgtggtaaggggtaacgtaaagttcccgttaggtacggtacctagttaccgttaaccgg

SEQ ID NO: 305048 - DNA, 546 bp, Homo sapiens
  misc_feature: GZ8MTXP02HA2IP.10.71.G05.1.454.CMB.2.raw
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcatcttagtaaatctggcatgtcctgggtccnccgtaggttccaggccgacgggctggaagtggggtggcagatatacaatatgatgacaagtaaaatatactatagganactccttacgaaggcccattcaccatctaccaganacaattaccaaagaacagtgtagtatctagacaatcgacagcctagagacgcccgaggtacgtacgggttacgtttagtaccgtggtaggggtaaagtaaacgttccgtaggtcggactacgtcctaaccgg

SEQ ID NO: 305049 - DNA, 584 bp, Homo sapiens
  misc_feature: GZ8MTXP02GBUH5.10.71.G05.1.454.CMB.2.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccgganaaattgtgttgacacagtctccagccagctgtctttgctccgaggggaaangccaccctctcctgcagggccagtcagagttgttcgctacttggttaggggtgtatcaacataaatccggccaggcctcccgaggctcctcatctttgatgtctttcaacgacgggcccctggccgtcccaggcgtaggttcaggtggcaggtgggtctggggacagacttcactctcaccatcagcagcctagacgcctagaagtattttgcttagtttatactgtcagcagcgtgcctacgtttcggacggtaggtcgccgtaacgtttcgggacggtaacgggaacctaaaaggtaggaacggttaaacgaaaacggtaacgtcggtacgacgttacggaaccaaccgtacgtcgttcgttccgttactacgtttccccg

SEQ ID NO: 305050 - DNA, 710 bp, Homo sapiens
  misc_feature: GZ8MTXP02F52KR.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggtccctgagactctcctgttctgcgtctggattcattctttaagtaatctggctagtcgtccgtgggtcccgccgtaggttcccgacgggcccgacggggctaggaagtggggtggaccagtataagtaacaattatagagtagaaactaaagttaaaaactattaacgtagtagggaacgtaccttacccgttaacgaaacggggtcctaactttaccaccctaagttaccctaccaagaacgtaaactaaacgttaaccaaacggaaaccgtagttacgggttagttaacttaccgtaggtaaacctaaaacgttacgaaacccgtaacggtaccccgtaaggaacgggaccggaacccgggtaaaacggggtaaccggtaaccggggggttttattttaaccgtttaacggtaagggttaaggggtaaaacgtaaaacgtttacggttacgggtacggtacttaaaccg

SEQ ID NO: 305051 - DNA, 625 bp, Homo sapiens
  misc_feature: GZ8MTXP02H9SR2.10.71.G05.1.454.CMB.2.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctccagacaccaccggagaaattgtgttgacacagtctccagccacgctgtctttgtctccgagggggaaagacgccaccctctcctgccagggccagtcagngttgttcgctactttcggttaggggtgtatcaacataaatccggcaggcctccaggctccnatctttgatgtctttcaacncgggcccctggccgtcccaggctagggttcaggtggcgaggtcggggtctggggacacggtaccttcnctctccaacctatccagcacgccctaagacgtcctaggtaagttacgttttgacttaaggtttttacttacttgttacagtccgtagccgttcgcccgttacggtttccgggcgggtaggttcgccgtacggtttcgggacggggaacggaacctaaaacggtaggacggtaaaccgaaaacggacgttcgtacgggcctacggaacctacctagttctacgttcctttacacgtttccccg

SEQ ID NO: 305052 - DNA, 603 bp, Homo sapiens
  misc_feature: GZ8MTXP02GVWZU.10.71.G05.1.454.CMB.2.raw
  modified_base (304)..(304): a, c, t, g, unknown or other
  misc_feature (304)..(304): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctctgttctgcgtctggattcattctttagtaatctggcatgtcctcggtccnccaggttccaggtccacgggctaggatggggtgccagatatacaatatgatgaactaagtaaaatataactataggactactacccttacgaaacgggcccgtaatttaccacctattcctacccgaagaacgaaactaaacttacccgaaagtaaccagttagggtataaagtccttagaccaaaagttcgaaccaacggccctaggaacggacgtaccgggaacggtacgtaaccggggttatttaacgttacggtaaggttagggaagtaaaacgtcctaaggttcggacttaacg

SEQ ID NO: 305053 - DNA, 660 bp, Homo sapiens
  misc_feature: GZ8MTXP02F7LW3.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgctacttcggttaggggtgtatcaacataaatccggcaggctcccagctcctcattctttgatgtctttcgaacgacgggcccctggccgtcccgaggcgtaggttcaggtcggcaggtgggtagtgggacagtaccttcgactctacaccatcgagcagccctagacgtcctagaacgttattttcgacttaagttttacttacgttacgtacagtcaggtccgttagtacccgttaaccgggttttcgggaccgggtacgggttcgacccgttaacggtttccgggaaccggggtaaacgggaaaacctaaaaaggtacgggaaacggtaaaccgtaaaaccggtaaacgttcgggtaacggtccgttaggaaccctaaccgtaattaccgttcggtttaccttacctacgtttcccccg

SEQ ID NO: 305054 - DNA, 610 bp, Homo sapiens
  misc_feature: GZ8MTXP02J1EU0.10.71.G05.1.454.CMB.2.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaangccaccctctcctgcagggccagtcagngtgttcgctacgtttcggttaggggtgtatcaanataaagtccggcaggctccaggctccncatctttgatgtctttcaacgcgggcccctggccgtcccgaggtctaggttcaggtggcgtaggtgggtcgnggggacagtacttcgactctacacatcagcagccagagcctagaagttntttgacttagtttactagtcttacgagctacggcgtcgccgtacgtttcgggcggtaggttcgccgtacggtttcgggacgggtaacgggaaacctaaaagtacgggaacggtaaacgtaaaacggtaacgtgggtacggtaccgtacggcctaacccgtacgttccggttacgttcctttacgtacctttccccg

SEQ ID NO: 305055 - DNA, 585 bp, Homo sapiens
  misc_feature: GZ8MTXP02IQLQF.10.71.G05.1.454.CMB.2.raw
  modified_base (301)..(301): a, c, t, g, unknown or other
  misc_feature (301)..(301): n is a, c, g, or t
  modified_base (447)..(447): a, c, t, g, unknown or other
  misc_feature (447)..(447): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagacgtccagtgtcagatgcagatggtgagtcgtgggggagcgtggtccggcgtgggggtcctgagactctcctgtctgcgtctggtattcattctttaagaaccgtggactatgtccgtcgggtccnccacgggttccacggtcccgacggggtctagggaagttggggtggacagtatataacgaatagtagatacgaacaaattaaaagtatactagtaggactacctccttagaaagggtccctaattccaacctactcctacaagtaanaacctaaattacccgaaagtactagtaggtataatcgtagactaaagtcacagactgaagagaccgagacgtacgggtatttagtacgtggaggtaacacttacacggtgactactcgaacgtggttattacggtacg

SEQ ID NO: 305056 - DNA, 575 bp, Homo sapiens
  misc_feature: GZ8MTXP02F1SMQ.10.71.G05.1.454.CMB.2.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaangccacctctcctgcagggccagtcagagtgttcgctacttcggttagggtgtatcaacataaatccggcaggctcccaggctcctcatctttgatgtctttcaacagggcccctggccgtcccaggcaggttcagtggcagtgggtctggggacagacttcnctcncacatcagcagcctagacgcctagaagtattttgctagtttatactgtctagctagcgtgcctacgtttcggacggtaggtcgtaccgtacgtttcgggacgggtaaggaaacccgtaaaagtacggtaacggtacgaaaacggtaacgtggtaacggtcgtacggaaccgaaccgtattcgttacgttccttacgtactttccccg

SEQ ID NO: 305057 - DNA, 676 bp, Homo sapiens
  misc_feature: GZ8MTXP02H40GH.10.71.G05.1.454.CMB.2.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgctacttcggttagggtgtatcaacataaatccggccaggctcccgaggctcctcatctttgatgctttcaacgaggcccctggccgtcccaggcaggttcaggtggcaggtgggtctggggacaggtacttcnctcgtcaccgatcagcacgacctagacgtcctagtaaacgtatttttacgacgttaagttttaacttacgttgtacgtagtacgtacggtcggttacgtacccgttacggttttccggggacgggttacgggtaccggtacccgttaacggttttccggggaacggggtaaacggggtaaaacccgtaaaaggtacgggtaaacgggttaaccgtaaaaacgggtaaccgttacggtacggtaccgtacggtaaccctaacccgtacgttaccgttaggtttacccgtttccgttaaactttcccccg

SEQ ID NO: 305058 - DNA, 575 bp, Homo sapiens
  misc_feature: GZ8MTXP02JQRXW.10.71.G05.1.454.CMB.2.raw
  modified_base (362)..(362): a, c, t, g, unknown or other
  misc_feature (362)..(362): n is a, c, g, or t
  modified_base (432)..(432): a, c, t, g, unknown or other
  misc_feature (432)..(432): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaaatctggcatgtcctgggtcccgctacggttccaggcccacgggctggaagtggggtgcagatatacaatatgatgacaagtaaatntactatggagactaccttcgaagggccgtattccaccatcctccagacgacaattcaaagaactatggtntatctagacaaatgaccagcctagagacgccggaaggacgtacggggttagtttaacgtacgttagggttacggggaaagtaaacgttacccggttaaggtcgggtactaaacgtccgtaaaccgttggggttaatttcgggg

SEQ ID NO: 305059 - DNA, 605 bp, Homo sapiens
  misc_feature: GZ8MTXP02G6636.10.71.G05.1.454.CMB.2.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctcaggggaanagccacctctcctgcagggccagtcagagtgttcgctacgtttcggttaggggtggtatacaacataaatccggcaggcctccaggctcctnatctttgatcgtctttacaacgacggcccctaggccgtaccccgaggcctaggttccaggtcggacgagggttcgggtcgtagggacaggtaccttcactctacaccatccagcacgacctagacgtctagaagttatttgacttaagtttatactgtcagntaacgtcgtacnccgttacggttcggacggtagtcgaccgttacgttaccggggacgggtaaaacgaacgtaaaagcgggtaaacggtaacgaaaaccggtaacgttcggacggctacggaacactactacgttactcctactacttccccg

SEQ ID NO: 305060 - DNA, 659 bp, Homo sapiens
  misc_feature: GZ8MTXP02FYCNR.10.71.G05.1.454.CMB.2.raw
  modified_base (625)..(625): a, c, t, g, unknown or other
  misc_feature (625)..(625): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcgtggtccggccgtgggggtcctgagctctcctgttctgcgtctggattcattctttaagtaatcgtggctagttcgtccgtcgggtcccgccgtaggttcccgagggcccgacggggtcgtaggggaagttggggtggaccagtaataagtaactaaatattagatagaaactaaagttaaaaatagttaacgttaagtacgggaaacgtaccttacccgttacgaaacggggtcccgttaattacccaccctaacttacccgtacccgaaagtaacgtaaacctaaacttaacccgaaaaggtaacctagttagggttataactcgttagaacgtaaaactcgaacctacgcctaggacggacgaccggaaggtacgtacggggttatttagttacgnggttacgggaataaacgtcgtaagcggtactacg

SEQ ID NO: 305061 - DNA, 687 bp, Homo sapiens
  misc_feature: GZ8MTXP02IPWWZ.10.71.G05.1.454.CMB.2.raw
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagacgtccagtgtcagatgcagatggtggagtcgtgggggagcgtggtccggccgtgggggtccctgagtctctctgttctgcgtctggtattcattctttagtaaacctggactatcgtccgtcgggtcccgcctaggtttcccaggcccgacgggcgtaggaagttgggtcggcagatataacatatgatgaactaaagttaaaatatacgtagtaggaagtaccttccgttacgaaacggggtccctaatttccaccctactcctacccgtaagaacgaactaaacttacccgaaaagtaaccaagttagggttattaagtacctttaggaactaaagttaccgaaccgacggtaccttaggaaacgacggacccgggaaaggtaccgtaaacgggggtttacgttttaaagttaccgtaggggttaggggaaaacgtaaaacgttccgtaagggtaacgggtacctaacggttaccctaaccgttaggtttacgttaacggtttcccggg

SEQ ID NO: 305062 - DNA, 577 bp, Homo sapiens
  misc_feature: GZ8MTXP02JFZ8J.10.71.G05.1.454.CMB.2.raw
  modified_base (304)..(304): a, c, t, g, unknown or other
  misc_feature (304)..(304): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattctttagtaatctggcatgtcctgggtcccncaggttccaggccacgggctggaagtggggtggaccagatatacaatatgatgaactaagtaaatatactatggaagtacttccttacgaacggggccctaatttcccaaccctattccctaccgaagaacgaactaaacttacccaaaagtaacagttgggtatactaccgtagaaccaaaagtcgaaccgagccctaggacgacgcccggaaggaccgtacggggttatttacgtacgtggttagggaataacgtcgtagtcggactaacg

SEQ ID NO: 305063 - DNA, 651 bp, Homo sapiens
  misc_feature: GZ8MTXP02HDW87.10.71.G05.1.454.CMB.2.raw
  modified_base (378)..(378): a, c, t, g, unknown or other
  misc_feature (378)..(378): n is a, c, g, or t
  modified_base (644)..(644): a, c, t, g, unknown or other
  misc_feature (644)..(644): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcattctttaagtaatctggctagtcgtcctgggtcccgcgaggttcccagggcccacggggctaggggaatcgggggtgccgtaaggtaacttataacgaaattagngtatagaaacgtaaagttaaaaatagtaaacgtaagtacgggggtaaacttaccgttacccgttaacggaaacgggccctaacttaccaaccctatacccgtaacaaggtaaccaaacttaaaccgttaacgaaacggtaaaacctggttacgggttacttaaggttacctaaggtaactaacgtaacgaccgtacgacccgtaggacgacgcggtaacggacgtacggttattacgttaggtggtacggaatacgtacgtacggngactacg

SEQ ID NO: 305064 - DNA, 662 bp, Homo sapiens
  misc_feature: GZ8MTXP02FW4EU.10.71.G05.1.454.CMB.2.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagngtgttcgctacgttcggttagggtgtatcaaacataaatccggccaggcctcccgaggcctcctcacttctttgatgtctttcaacgcggcccctggccgtcccgaggcgtaggttcaggtggactaggtcggggtctgggacaggtaccttcacgtctacaccatcagcacgcctaagcgtccgtaagaagttagttttacgacgtttaagttttacttacgtgtactaaggctagtcgtcgtacccgtacggtttgggaccgggtaggtccgtaccgttacggtttccgggaacggggtaacgggtaaaacccgtaaaaggtacgggtaaacggtaaaccgtaaaaacgggtaacgttcgggttacggacgttacggaacccgtaaaccctagttccggttacgttcctttaactacctttcccccg

SEQ ID NO: 305065 - DNA, 644 bp, Homo sapiens
  misc_feature: GZ8MTXP02J0RQP.10.71.G05.1.454.CMB.2.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgctacgttcggttaggggtgtatacaacataaactccggccaggcctcccaggcctcctcattctttgatgtctttacaacgcgggtcccctggccgtcccaggcaggttcaggtggctaggtgggtctgggacagtaccttcacctctacaccatcgagcagcctagagcctagaagttntttgacgttagtttattacgtgtacagtctagtcgtcgtaccgtacggtttcggggaccgtagggttcgtacccgttacggtttaccggggaccggggtaaacgggtaaaaccgtaaaaaggttacgggaaacgggtaaccgaaaaaccgggtacgttagggacggtaccgtacggtaaccaaacccgttgtaccgttacggtttccttacgtacgtttccccg

SEQ ID NO: 305066 - DNA, 589 bp, Homo sapiens
  misc_feature: GZ8MTXP02F7HXC.10.71.G05.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagngtgttcgctacttcggttagggtgtatcaanataaagccgcaggctccgaggctcctcatctttgatgtctttcaacgacggcccctggccgtcccgaggcctacggttcaggtcggctaggtgggtagtgggaacagtaccgtttcacttctacacccgtatccagcacgtacctagacgcctagaagtattttacgcttagtttacttactgtacagtcgagtcgtcgaccttacggtttcgggccggtaggtcgtaccgttacggttcgggacggaacgggtaacctaaaagtacggacggtaacgaaaacgtacgtcgtcggctacgcacgtactcgtgtcttactactttcccg

SEQ ID NO: 305067 - DNA, 703 bp, Homo sapiens
  misc_feature: GZ8MTXP02F3PH8.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggccgtgggggtccctgagactctcctgttctgcgtctggattcatctttagtaaatctggcatgtccgtgggtcccgccgtaggttcccaggcccgacggggcttgggaagtggggtggacgagataatacaatatgaataggaactaaagttaaaatacgtaactaagtaggtaacgtaccttacccgtttaacgaaacgggggtccctaaatttacccaaccctaacttcctaacccgaaagacgtaaacctaaacttacccaaaaggaacctaagttaggttagttacttacctagggtaaacctaaaaagtccgaaacccgacggtacccgtaggaacggaaccggacccgggtaaagggaccggttacgggggtttatttttaacggttacggttagggttaacggggaaagtaaaacgttccggtaaggttaccgggacttacgtacctaaccggtttggttaacgttttcggg

SEQ ID NO: 305068 - DNA, 719 bp, Homo sapiens
  misc_feature: GZ8MTXP02F2ZZ9.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggccgtgggggtccctgagctctcctgttctgcgtctggattcattcttagtaaatctggcatgtccgtgggtcccgccgtacggttccgagggcccacggggtcctagggaagtggggtggccgagtatagtaacaaatatgagtagaactaaagttaaaatataactagtaggaacgtaccttcccgttaacgaaacggggtccctaatttaccgaaccctaattccgtacccgaaagaacgtaaacctaaaactttacccgaaaaggtaaacctagtttacggggttagttaaacttccgtacggtaactaaaacgttcggaaaccctacggtaccccgttagggaacggaaccgggaccccgggtaaaaggggacccggttaaacgggggtttacgtttttaaacgtttaaccggtaacggggttaaggggaaaacgttaaaaccgttcccggtttaaaggtaccggggtactttaaaccgg

SEQ ID NO: 305069 - DNA, 561 bp, Homo sapiens
  misc_feature: GZ8MTXP02HLIGW.10.71.G05.1.454.CMB.2.raw
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctgagctctcctgttcngcgtctggtattcattctttagtaatctggcatgtcctgggtccnccgtaggttccaggccgacgggctgggaatggggtgccagatatacatangatgaactaaagtaaaatatactagtggagtactccgttagaacgggtccaattaccacctatcctaccagacaactaacttaccaaagtaacagttgggtatatcgtagacaaatcgaacctagcccttagacgacggaccgaaggaccgtacgggttagtttactaggtgtacgggaaataacgtcctaaggtcgtactacg

SEQ ID NO: 305070 - DNA, 669 bp, Homo sapiens
  misc_feature: GZ8MTXP02IDOQZ.10.71.G05.1.454.CMB.2.raw
  modified_base (260)..(260): a, c, t, g, unknown or other
  misc_feature (260)..(260): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttcngcgtctggattcattctttagtaaatctggctatcgtccgtgggtcccgccgtaggttcccagggcccacggggctagggaacgtggggtggccaagtatagtaacaaattagtagatagaaactaaaggttaaaaaattattaactaagtacggggaacgtaccttacccgtttacgaaacggggtcccgtaatttcccgaaccctacttaccctaccagaacgaaacctaaaagtttaccccaaaaggtaaaccagtttcgggtagttactacgttaggaactaaaactcggaaccacgtcccgtaggaacggcggaacccggtaagggaaccgtacgggggtttagttttaacgttacggttaagggtaggggtaaacgtaaactccgttaggtacggtactaacg

SEQ ID NO: 305071 - DNA, 566 bp, Homo sapiens
  misc_feature: GZ8MTXP02ITCDG.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcatctttagtaatctggcatgtcctgggtccgcctaggttccaggccacgggctggagtggggtgcagatatacaatatgatgacaagtaaaatataactagtaggagtactccgttacgaagggccgaattcaacccatcctacagaagacaattaccaaagaacagtggtagtatacctagacaaatcgaaaccagacctgaacgacggaccggaagggacgtacggggttagtttacgtacgtggtagggaagtaaaacgttccgtaaggtcggtactacgtaccgttaaccgg

SEQ ID NO: 305072 - DNA, 621 bp, Homo sapiens
  misc_feature: GZ8MTXP02IOIMU.10.71.G05.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggccgtgggggtccngagctctcctgttctgcgtctggnttcattcttagtaatctggcatcgtccgtggtcccgctacggttccacggcccgacgggcgtaggagtggggtgccagatatacaatangntagaactaaagttaaaatntaactagtaggatactccgttacgaacgggcctaattaccacctagtcctaccagacgaaactaacttaacccaaagtaacctagttaggttacgtactaccttagaactaaaacgttcgaaaccgagtacccgtaggaacggacggaccggaaaggtaccggtaacgggtttacgtttaacgttaacggttaaggtaacggggaaacgttaaacgttaccgtacggtttacggacctaacg

SEQ ID NO: 305073 - DNA, 646 bp, Homo sapiens
  misc_feature: GZ8MTXP02F8MFK.10.71.G05.1.454.CMB.2.raw
  modified_base (275)..(275): a, c, t, g, unknown or other
  misc_feature (275)..(275): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctggagactctcctgttctgcgtctggnttcattctttagtaaatctggcatgtccgtgggtcccgccgtaggttcccagggcccacggggtctgggaatggggtgccgagatatacaatatgatgaacaagtaaaatataacgtataggaagtaccttaccgttacgaaacggggcccgtaactttaccaacccctaatcccgtacccgaaagacgtaaactaaacgttacccaaaagtaacctaagttagggttagtaaacgttctaggaaccaaaatcggaaaccctaacggacccttaggaaggacggaccggaagggtaaccgtaacggggttagtttaacgttacggtaagggttaggggaaagtaaaacgttccgtaaggtcggtactaacg

SEQ ID NO: 305074 - DNA, 582 bp, Homo sapiens
  misc_feature: GZ8MTXP02GRZV4.10.71.G05.1.454.CMB.2.raw
  modified_base (297)..(297): a, c, t, g, unknown or other
  misc_feature (297)..(297): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaagagccaccctctcctgcagggccagtcagagtgttcgctacttcggttaggggtgtatcaaactataaactccggcaggcctcccgaggctcctnatctttgattgctttacaacgtcgggcccctgggccgtcccgaggcctagggttcaggtcggcaggtcggggtctgggactagaccttcgactcacaccatcagcacncctagacncgtagaattgtttagcttagtttatctgtcagcagcgtgcctacgttcggcggtaggtcgtccgtacgtttcgggacgggtacggaaacctaaaagtcggaaagtacgaaaacgtaacgtggacggctaggaaccgtacctagtctcgttacttacctacgtttccccg

SEQ ID NO: 305075 - DNA, 682 bp, Homo sapiens
  misc_feature: GZ8MTXP02F4EL3.10.71.G05.1.454.CMB.2.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggggaaancgccaccctctcctgcagggccagtcagagtgttcgctacgttcggttaggggtgtatacaactataaactcccggacaggcctcccgaggctcctcattcttgatgtctttcaacgcggcccctggccgtcccgaggcgtaggttcaggtggcaggtgggtctggggacagtaccttcactctacaccatcagcacgcctagacgcctagaagttattttacgactttagttttaacttacgtacgtactaggtaccacggtccgttacgacccgttaacgggtttccggggacgggtagggttccgtacccggttaacggtttccggggaaccggggtaaacggggtaaaacccgtaaaaaggttacgggaaacgggttaaacccgaaaaacgggtaccgttaggggtacggtaccgttacgaacccgtaaccgtaacgttaccggttacgttcctttaacgtccttttacccccg

SEQ ID NO: 305076 - DNA, 622 bp, Homo sapiens
  misc_feature: GZ8MTXP02JIVXE.10.71.G05.1.454.CMB.2.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
tcagcatagtagtgcacgaccggtgctcgatttagtgtcgtcgcaagagagagggggaggaactgctcagttaggacccagagggaaccatggaagcccccagctcagcttctcttcctcctgctactctggctcccagacaccaccggagaaattgtgttgacacagtctccagccacgctgttctttgtctccgaggggaanacgccaccctctcctgcagggccagtcagagtgttcgctacgttcgttaggggtgtatcaanataaatccggcaggctccgagctcctcatctttgatcgtctttcaacgcgggcccctggcccgtcccgaggtcctaggttcaggtggcaggtgggtcgtgggacaggtcttcgcttctcacctatcacgcagcctagacgtcctagaaattagttttgcttaagtttattactgtctagctaggcgttcgccttacgtttcgggacggtagggtcgtaccgttcgtttaccgggaccgggtaagggaaaccctaaaaggttcggaacgggtaaaccgaaaacggtaacgttacggttacggaccgttacggaaccgtacctaacgttccgttgttacctttaccgtactttccccg

SEQ ID NO: 305077 - DNA, 530 bp, Homo sapiens
  misc_feature: GZ8MTXP02G90HJ.10.71.G05.1.454.CMB.2.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (456)..(456): a, c, t, g, unknown or other
  misc_feature (456)..(456): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttcngcgtctggattcattcttagtaaatctggcatgtccgtgggtcccgccgtaggttcccaggccacgggctggaagtggggtgcagatagtacaatatgatgaacaagtaaaatntactagtgatactctgaaggcctatacactatctaccagtacactaattaccaaagtaacagtggtatattcagacaaatcgacagcctagngacgtcgagacgacgggttnttacgtacgtggtagaactaacgtcgtaagtgactactctaccgtgttacttgg

SEQ ID NO: 305078 - DNA, 607 bp, Homo sapiens
  misc_feature: GZ8MTXP02ILD0A.10.71.G05.1.454.CMB.2.raw
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctggagctctcctgtctgcgtctggattcatccttagtaatctggcattcgtccgtggggtcccgccgtacggttcccagggcccacggggctagggaagtggggtggccagatataacaatangatagaactaaagtaaatatacgtatggactcttaccctcgaaagggcccaattccacctatcctaccagaacgaaccaactaccaaacggtaanacgttagggtatctacgtagaaccaaagtcgaaaccgagacccgtaggacgacggaccgggaaaggtaccggtacgggtttagttaaccgttaggtaaggttaagggggtaactaaaaggttcccgtaaggttcggactaacg

SEQ ID NO: 305079 - DNA, 630 bp, Homo sapiens
  misc_feature: GZ8MTXP02IL0ER.10.71.G05.1.454.CMB.2.raw
  modified_base (362)..(362): a, c, t, g, unknown or other
  misc_feature (362)..(362): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctggagctctcctgttctgcgtctggatcattctttagtaaatctggcagtgtccgtgggtcccgccgtaggttcccaggcccgacgggcgtgggaagtggggtggcagatatagaatatgatgaanaagttaaaatattaactaagtaggaacgtactaccgtttacgaaacggggccctaattaccaaccctatacctaccaagaacaaacctaaagttaacccaaaagaaccaagttagggttataactttcagaccaaaagtcgaaaccgcgaccgtagaacgacggccgtaaaggaacgtacggggtttatttaacgttacggttagggtacggtaaaagtaacgtaccgtaaggtcggactacgtctaaccgtggtttaacctttcggg

SEQ ID NO: 305080 - DNA, 594 bp, Homo sapiens
  misc_feature: GZ8MTXP02G6UNK.10.71.G05.1.454.CMB.2.raw
  modified_base (244)..(244): a, c, t, g, unknown or other
  misc_feature (244)..(244): n is a, c, g, or t
  modified_base (384)..(384): a, c, t, g, unknown or other
  misc_feature (384)..(384): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtcctgngactctctgttctgcgtctggattcattcttagtaaatctggcagttcgtccgtggggtcccgccgtagggttcccagggcccgacgggctagggaagtggggtgccagatatacaatatgatagaactaaagtaaaatntaactagtaggaacgtacttacccttagaacggggaccctattaccacccatcctaccaagacgaactaaacttaccaaagtaactagttgggtataactcgtagaactaaagtcgaaccagcccgtagacgacgccggaaggtacgacgggtttatttaacgttagtaaggttagggaaacgtaaacgtccgtaaggtcggtactaacg

SEQ ID NO: 305081 - DNA, 639 bp, Homo sapiens
  misc_feature: GZ8MTXP02GG4JT.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcatctttagtaaatctggcatgtccgtgggtcccgcctaggttccagggcccacgggctggaatggggtggccagatatacaatatgatgaacaagtaaaatataactatagggagtaccttcccttacgaaaggggccctaatttacccaaccctattcctacccaagaacgtaaaccaaatttaccccaaaaggaacctaagttacgggtagttaaacttccgtaggtaactaaaaacgttcggaaacccctaggacccttaggaacggacgacccgggaaaggaaccgtacgggggtttagtttactttaacgtaagggttacgggaaagtaaaacgttcccgttaaaggtcggaccttaacgg

SEQ ID NO: 305082 - DNA, 570 bp, Homo sapiens
  misc_feature: GZ8MTXP02FTG0J.10.71.G05.1.454.CMB.2.raw
  modified_base (246)..(246): a, c, t, g, unknown or other
  misc_feature (246)..(246): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtggggtcccngagctctctgtctgcgtctggattcattcttagtaatctggcatcgtccgtgggtccgccgtaggttccgaggccgacggggtctagggaagtggggtgaccagatagtacaatatagatagaactaaagtaaaatataactagtaggacgtactacccttacgaacgggtcctattaccacctatcctaccgaagtacaaactaacttaccaaagactagtgggtatactctagactaaagcgaaccagccgtagacggacgacggaggacgtacggggttactttagtacgtggtaggaacgtaacgtcgtagtcgactacg

SEQ ID NO: 305083 - DNA, 683 bp, Homo sapiens
  misc_feature: GZ8MTXP02HJ9G0.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatcttagtaaatctggcatgtccgtcgggtcccgccgtaggttcccgacggcccgacggggccgttagggaaggttcggggtgggaccaaagtataacgtaacaaattaatagaagtacgaaactaaaggttaaaaaattattaaacttaaagtaggtaacgtaaccctttcccgttaacgaaaacgggggcccttaaattccctaaacccacttaccctacccgaaggaacgtaaacctaaacttaacccgaaaaggaaacctagttaggttagttaacttccgtagtaccaaaatcggaaccaggcccgtagaacgacggaccgacgggtaaccgtacggggtttatttaagttacgtaggtacgggaagtaaactccggtaagttcggactacgtctaccgttggttacgttcgg

SEQ ID NO: 305084 - DNA, 634 bp, Homo sapiens
  misc_feature: GZ8MTXP02GH6WE.10.71.G05.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttagggtgtatcaacataaactccggcaggctcccaggctcctnattctttgatgtctttacaacgacgggcccctggccgtacccgaggcctaggttcaggtggctaggtgggtctggggacaggtaccttcgacctctaccaacccgatccaagccaacgccctaggacgtcctagaagtattttcgactaagttttatactgtcagccagtcgtgcctacgtttcgggacggtaggtcgtaccgtacggtttcggggacgggtaacggggaaacctaaaaagttacgggaaacgggttaaaccgaaaaacggtacgtacgggtacggtaccttacggaacctaaccgtacggttacttcgttacctttacgtaactttcccccg

SEQ ID NO: 305085 - DNA, 608 bp, Homo sapiens
  misc_feature: GZ8MTXP02GZF87.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctggagactctcctgttctgcgtctggattcatctttagtaaatctggcatgtccgtgggtcccgccgtacggttccgacgggtcccgaacggggtccttgggaaagtcggggtggccaggataatacaatatgatgaacaagttaaaaatataactaatagggaactacctcccgtttagaaacgggccgtaattaccacctaatcctacagacgaactaaattaccaaaagtaactatagggtataactcgagtaacaaaagtcgaaaccagacccgagacggacgacccggagggtaacccgaggggtttactttaagtaccgtgtaggggaactaaaacgtccgtaaggtcggactacg

SEQ ID NO: 305086 - DNA, 553 bp, Homo sapiens
  misc_feature: GZ8MTXP02JRDCP.10.71.G05.1.454.CMB.2.raw
  modified_base (309)..(309): a, c, t, g, unknown or other
  misc_feature (309)..(309): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctgagactctcctgttctgcgtctggattcattctttagtaaatctggcatgtcctgggtccncaggttccagggccacgggctggaatggggtgccagatatacaatatgatgaactaagtaaaatataactatagggatacctcccttacgaacggggccgattcacctatcctaccagacgaactaaacttaccaaagaactagtagggtagtatctagacaaatcgaccagacctagacgagccgaggacgtacgggttagtttactacgtggtagggaacgtaactccgtagtcggactacg

SEQ ID NO: 305087 - DNA, 569 bp, Homo sapiens
  misc_feature: GZ8MTXP02FHWLA.10.71.G05.1.454.CMB.2.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgcacttcgttaggggtgtatcaacataaatccggccaggctcccaggctcctcatctttgatgctttcaacacgggcccctggccgtccccaggcaggttcaggtggcaggtgggtctggggacagacttcnctctcaccatcagcagcctagagcctgaagtattttgctagtttattactgtcagcagcgtagcctacgtttcggaccggaggtcgccgtacgtttcgggacggtaaggggaaccctaaaaagtaggaacggtaacgaaaacggtaaccgtaggtacggctcggaacgacctaacgtctcgtccttactacgttccccg

SEQ ID NO: 305088 - DNA, 588 bp, Homo sapiens
  misc_feature: GZ8MTXP02J1UWJ.10.71.G05.1.454.CMB.2.raw
  modified_base (247)..(247): a, c, t, g, unknown or other
  misc_feature (247)..(247): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtggggggtccctgngactctcctgttctgcgtctggattcatctttagtaaatctaggcatgtcctgggtcccgcgaggttcccagggcccacgggctggaacgtggggtggccaggatatacaatatgatgaactaagtaaaatatactatggacgtacttccgttacgaaacggggtccaattccaaccatttccacccaggtaacaactaaactttcccgaaaagtaacctagtacggggttataattccgttaggaacaaaacttggaacccaggcctacgagacggaccgtaggacgtaacgggtgtttaactaacgtggtaggaacgtaactacgtaggtggactaacg

SEQ ID NO: 305089 - DNA, 697 bp, Homo sapiens
  misc_feature: GZ8MTXP02GW1UY.10.71.G05.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccacctctcctgcagggccagtcagngtgttcgctacttggtaggggtgtatcaaacataaagtccggcaggcctcccgagcctcctcatctttgatgtccttacgaacgcgggcccctggcctcccgaggtcaggttcaggtggacctagggtcggggtactaggggactacggtaccttcnccgttcctacgacctatcccgaggccacgtacccgtagaccgtccgtaaggaaacgttagtttttacggactttaaggtttttaacttaacgtacgttaccgaaacggtccgtaacggtccggttaacgccccgttaacgggtttcccgggggacggggttacggttccgtcccggttaaacggtttccgggggaaccgggtaaacggggtaaaaccctaaaaaggtggtaaacggtaaaccgaaaacggtaaccgttggtacggacttggaaccctacgtacttcgtacttcctacgtactttccccg

SEQ ID NO: 305090 - DNA, 680 bp, Homo sapiens
  misc_feature: GZ8MTXP02F4OIC.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtccctgagctctcctgtctgcgtctggtattcattctttagtaaatctggctatcgtccgtgggtccgccgtaggttcccagggcccgacggggtctagggaagtggggtggccgagatataacaatatgatgaactaaagtaaaatatactaagtggaacgtacttacccgttacgaaacggggtccctaatttaccaaccctagttaccctacccgaaagtacgaaacctaaacttaacccgaaaaggtaaacctaggttagggttagtaacttaccgttagaacctaaaagttccgaacccaagtaccccgtaggacggaacggaccccgggaaaggggtaaccggttaaccgggggtttattttaacgtttaaccgggttaagggttaaaggggtaaacgtaaaacgttcccggttaaggttacgggactttaacccg

SEQ ID NO: 305091 - DNA, 518 bp, Homo sapiens
  misc_feature: GZ8MTXP02I3EUQ.10.71.G05.1.454.CMB.2.raw
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggtttccgtcgttagctcttttaagaggatgtccagtgtcagatgcagatggtgagtctgggggagcgtggtccggcgtgggggtccctgagactctcctgttctgcgtctggattcatcttagtaaatctggcatgtccgtggtccgccaggttccaggccacgggctggaatgggtggccagatagtacaatatgatganaagtaaatagtatagtgagactcctagagggcatcacatcncaganacaatcaagacatggtatatctagacaaacagacacgacgtacgagacgacgacggacgtacggtacgttagttacgtaagtaggaacgtaacgtacgtacgtacgtacgtacg

SEQ ID NO: 305092 - DNA, 564 bp, Homo sapiens
  misc_feature: GZ8MTXP02IQ7TR.10.71.G05.1.454.CMB.2.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgctacttcgttaggggtgtatcaacataaatccggcaggctccagctcctcatctttgatgtctttacaacgacggcccctggccgtcccaggctaggttcaggtggcaggtggtctggggacagtaccttcactctacaccatccagcacgcctagacgcctagtaagtattttgacttagtttattactgtacagcagcgtgacctacgtttcggcggtacggtcgccgtacgtttcgggacggaacggaaccgtaaaagtacggaaggtaccgaaaacgtactcggtacggctagaaccacgatcgtagtccttacgtacttccc

SEQ ID NO: 305093 - DNA, 539 bp, Homo sapiens
  misc_feature: GZ8MTXP02FY6FY.10.71.G05.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttaggggtgtatcaacataaatccggcaggctcccaggctccncatctttgatgctttcaacgcgggcccctggccgtcccgaggctaggttcaggtggcaggtgggtctggggacagaccttcnctctcaccatcagcagcctagagcctagaagtattttgcttaagtttacttactgtcagcagcgtagcctacgtttcggcggtaggtcgccgtacgttcggacggacggaacaaaagtaggaggtacaaacgaacgtgtacgctgcactactctgtctacacttccg

SEQ ID NO: 305094 - DNA, 722 bp, Homo sapiens
  misc_feature: GZ8MTXP02IAPU5.10.71.G05.1.454.CMB.2.raw
tcagcatagtagtgcacgaccggtgctcgatttagtgtcgtcgcaagagagaggggagctctgggagaggagcccagcactagaagtcggcggtgcctccatttcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtcctgagactctctgttctgcgtctggtattcattcttagtaaatctggcatgtcctcggtccgctaggttccagggccacgggcgtaggaacgtggggtgccgagtatatactaatagtgtataggaaactaaagttaaaaatattaacgtaataggaacgtacttcccgttacgaacggggtacctaacgtttaccaacctattacctacccgaaaggaacgtaaacctaaactttacccgaaaagtaaacctaagttacgggttaagttaactacgtaacgtactaaaacggttactaaccccgaggtaacccgttacggaacgggaccgggtaaccccgggaaagggggtaaaccgggttaaacccgggggtttacggtttttaaaagtttaaaccgggttaacgggggtttaacggggtaaaaggttaaaaccgttaccccggtttaaacggttacggggtaacctttaaacccgg

SEQ ID NO: 305095 - DNA, 731 bp, Homo sapiens
  misc_feature: GZ8MTXP02JVJG0.10.71.G05.1.454.CMB.2.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggcgtggggtcccngagctctctgttcngcgtntggnttcattcgtttagtaactcgtggctagttcgtcccgtgggtccccgccgtacggttcccacgggtcccgacgggtcgtacgggaaagtcgggggttacgacccgtaggtaacttaataaaccgaaagttagtaggtagttaacggaaacgttaaaggttaaaaaattacgtaaacgtttaagtagggaaaccgttaaccgtttacccgttaacggaaaccggggtacccgtaactttaccaacccgtacttacccgtaccgtaacggaaacgtaaacctaaacgttaaccgaaaacggtaaacgtacgttagggttaacgttacgtacgttagaaccgtaaaacgttcgaacccgtagcccgtaaggacgaaccgggcggtaacggaaccgttacggggttagtttaacgttcggtaaggtacggggtaaacgtaaacgttccgtaaaggtcgaacgttaacgg

SEQ ID NO: 305096 - DNA, 616 bp, Homo sapiens
  misc_feature: GZ8MTXP02JS7M7.10.71.G05.1.454.CMB.2.raw
  modified_base (286)..(286): a, c, t, g, unknown or other
  misc_feature (286)..(286): n is a, c, g, or t
  modified_base (436)..(436): a, c, t, g, unknown or other
  misc_feature (436)..(436): n is a, c, g, or t
  modified_base (472)..(472): a, c, t, g, unknown or other
  misc_feature (472)..(472): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtgggtccggccgtggggggtccctgagactctcctgttctgcgtctggtattcattcttagtaatctggnatgtcctgggtcccgccgtaggttccaggcccgacggggctagggaagtggggtggcaagtatatacaatatgatagaactaaagttaaaatataactagtaggatactccgttacgaacggggcctaattccgacctactcacccaganaacctaactaccaaagaacagttgggtatactctanaacgtaaatcgaaccctagacccgtagaacgggacgaaccgggaggaccggtaacgggttagttttaacgttacggtagggtagggtaaactaacgttccggtaaggttggacctactacccgtaccgtaggttatttacgggg

SEQ ID NO: 305097 - DNA, 526 bp, Homo sapiens
  misc_feature: GZ8MTXP02H096A.10.71.G05.1.454.CMB.2.raw
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttctgcgtctggattcattcttagtaaatctggcatgtccgtgggtccgcaggttccagggccacgggctggaatggggtgccagatatacatangatgacagtaaatntatatgagactctacaggccattcacatctcagagacaattccaaagtaacagtaggtagtatctagacaaaatgaaccagcctagacgacggccgaagggactacggggttacgtttattacgttggtagggaataaaacgtccgtaggtcggactaag

SEQ ID NO: 305098 - DNA, 691 bp, Homo sapiens
  misc_feature: GZ8MTXP02G1V9R.10.71.G05.1.454.CMB.2.raw
  modified_base (387)..(387): a, c, t, g, unknown or other
  misc_feature (387)..(387): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctgagactctcctgttctgcgtctggattcattctttagtaatctggcatgtccgtgggtccgccgaggttcccagggccgacgggctagggaagtggggtggcccagatagtacaatatgatagaacaagttaaaaactntaactagtaggaatactacccgttacgaaacggggtcctaatttaccaaccctaactcctacccgaagaacgtaaacctaaattaaccccgaaaagtaaacctagttacggggtattaacgttaccgtaaggaacctaaaaagttccggaaacccgtaaaacggccccgttaaggaaacgggaccggacccgggaaaggggaaacccggttaacgggggtttaccgtttttaaagttttaaccggtaagggtttaggggaaaacgttaaaacgttcccgttaaaggttccgggaactttaaccg

SEQ ID NO: 305099 - DNA, 540 bp, Homo sapiens
  misc_feature: GZ8MTXP02IW1EG.10.71.G05.1.454.CMB.2.raw
  modified_base (372)..(372): a, c, t, g, unknown or other
  misc_feature (372)..(372): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcattctttagtaatctggcattgtcctgggtccgccaggttccaggccgacgggctggaatggggtggccagatatacaatatgatgaacaagtaaaatntactagtgatactccttcgaagggccgattccacctatcctccagacgacaaacttaccaaagaactagtggtagtatcctagacaaatcgaacagcctagagagcgaaggacgtacgggttagtttacttacgtggtagggaagtaaacgtccgtagtcggactacg

SEQ ID NO: 305100 - DNA, 619 bp, Homo sapiens
  misc_feature: GZ8MTXP02FOL8A.10.71.G05.1.454.CMB.2.raw
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaagacgcccaccctctcctgcagggccagtcagagtgttcgctacttcggttaggggtgtatcaacataaatccggcaggctcccaggctctcatctttgatgtctttcaacacgggcccctgggccgtcccgaggcgtaggttccaggtcggcgaggtcggggtctggggacaggtacttcactcctacaccatcagacacgcctagacgtcctagaagtagttttgacttaagtttattacgtgtcagcacggtcgtcgcccgtacggtttcggacggtaggtcgccgtacggtttcgggacgggtaacgggaacctaaaagtacggaacggtaaccgaaaacggtaaacgtcgggtacgtacgtacggaaccctaaccgtacgttccgttcgttacctttaccgtctttacccccg

SEQ ID NO: 305101 - DNA, 533 bp, Homo sapiens
  misc_feature: GZ8MTXP02GX61I.10.71.G05.1.454.CMB.2.raw
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagactctcctgttctgcgtctggattcatctttagtaaatctggcatgtcctgggtccgccaggttccaggccacgggctggaatggggtgcagatatacaatatgatgacaagtaaaatatactatgganactcttnaagggccattcaccatcctccagtacgacaattaccaaagaaacagtggtagtatctagacaaaatgaaccagcctagacgacgccgaaggactacgggtatttacgtacgtggtaggggaataaaacgtccgtagtggacacgtactaacg

SEQ ID NO: 305102 - DNA, 548 bp, Homo sapiens
  misc_feature: GZ8MTXP02HY4MS.10.71.G05.1.454.CMB.2.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (389)..(389): a, c, t, g, unknown or other
  misc_feature (389)..(389): n is a, c, g, or t
  modified_base (494)..(494): a, c, t, g, unknown or other
  misc_feature (494)..(494): n is a, c, g, or t
  modified_base (524)..(524): a, c, t, g, unknown or other
  misc_feature (524)..(524): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtcctgagctctctgttcngcgtctggatcatcttagtaatctggcatgtcctgggtccncgtagtccgaggccgacggctggagtgggtgcagatagtacaatatagatagaactaagtaaaatatactagtgactacctctacgagggcctatccacntcaccgagacgaactaactaccaaagaacagttggtatacttcagacaaatcgaccctaggtccaggacgacgacgaaggtacgtacgggtttatttacgtacgnggttagggaaactaacttcgaagtgtaacncgttaccgacgtttggtaattcgg

SEQ ID NO: 305103 - DNA, 614 bp, Homo sapiens
  misc_feature: GZ8MTXP02GCU8Z.10.71.G05.1.454.CMB.2.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgtcngcgtntggattcattcttaagtaactctggctagtcgtccgtgggtcccgccgtacggttccgacgggcccgacggggctaggtaagtggggtgcctaggtatagtaacaatatagatagaactaaagtaaaatataactagtagacgtctacccgttacgaaacgggtccgtattaccacctatcctaccagacgaaactattacccgaaataacgtagtagggttataatcgtagactaaaatcgaaccacgcctaggacgaacgcggtaaacggaccggttacgggttatttaacgttacggtaaggtttaagggaacgttaaacgtacccgttaggtcgaacgtttaaccg

SEQ ID NO: 305104 - DNA, 706 bp, Homo sapiens
  misc_feature: GZ8MTXP02FYX9F.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatgggtggagtcgtgggggagcgtggtccggcgtggggtcctgagctctcctgttctgcgtctggattctattacttagtaatctggctagtcgtccgtgggtcccgcgtacggttccacgggcccgacggggtctagggaagtggggtggaccaagtactaagtaactaaatacgtgtactagaaactaaaagttaaaaatataacttaagtaggaaacgtaccttaccgttacgaaacggggtcctaattaccaccctatccctacgaaacgacaaacctaacttaacccgaaaagtaacctaagttacgggtataaacttcgtaacgtaacaaaacgttcggaaaccccacggtacccgtaaggacgggaaaccggtaccccggggtaaaagggtaccgggttaaccgggggtttagtttttaaccgtttaaacgggtaacgggttaagggggtaaaacgtaaaacggttcccgttaaggttacgggaccttaaaccgg

SEQ ID NO: 305105 - DNA, 635 bp, Homo sapiens
  misc_feature: GZ8MTXP02JMPUS.10.71.G05.1.454.CMB.2.raw
  modified_base (380)..(380): a, c, t, g, unknown or other
  misc_feature (380)..(380): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcggtgggtccggcgtgggggtccctggcgactctctgtctgcgtctggattctattctttaagtaactcgtggctagttcgtccgtcggggtccccgcgtacggttccgacgggcccgacggggcgtaggtagtggggtgaccagatataacatangatacgaaactaaagtaaaatataactagtaggaactaccttcccgttagaacgggtccgtaacttaccaccctatccctacaagaactaacctaaacgttaccaaaaggtaactaggttcgggtattatctagacaaagtcaaccgtacgaccgtaggacgacggaccggacggtaacgtaccgggttttagttaacgttacggtaaggggtaacggggaaactaaccggttacgtacggtacggacttaaccg

SEQ ID NO: 305106 - DNA, 636 bp, Homo sapiens
  misc_feature: GZ8MTXP02HKUEM.10.71.G05.1.454.CMB.2.raw
  modified_base (581)..(581): a, c, t, g, unknown or other
  misc_feature (581)..(581): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtcctgagctctctgttctgcgtctggattcattctttaagtaatcgtggctattcgtccgtcggggtcccgccgtacggttcccagggcccgacggggctaggggaagtggggtgccgaagtatactaactaatagtgatgaactaaagtaaaatataacgtagtagggaactacttacccgttagaaacggggtccctaattacccgaacctacttacctaccgagtaacgtaacctaacttaccgaaagtaactagtagggtatactcgtagaactaaaagtcgaaaccgacgccgttaggaacggtacggacccggaaagggtaccgtacgggggtttnttttaacggtacgtaaggtaggggtaactaaacgttccgtaaggtcgtaactacg

SEQ ID NO: 305107 - DNA, 611 bp, Homo sapiens
  misc_feature: GZ8MTXP02JHC8V.10.71.G05.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (418)..(418): a, c, t, g, unknown or other
  misc_feature (418)..(418): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagttgttcgctacttcgttaggggtgtatcaacataaactccggcaggcctcccaggctcctcatctttgatgtctttcaacncggcccctggccgtcccgaggcaggtttcaggtggacaggtcgggtacgtgggactaggtaccttcacgtctaccaccagtcggacacgcctagcgcctagaagtntttgacttagtttattactgtacagtactagcgtacgcctacggtttcgggacgtacggtcgccttacgtttcggggacggtaacgggaccaaaagttacggaacggtaccaaacggtaaacgtgggtacggtaccgttaggacccaaccgtaacgttcttacggttccttactaccgttcccgtttaccccg

SEQ ID NO: 305108 - DNA, 669 bp, Homo sapiens
  misc_feature: GZ8MTXP02IBXWI.10.71.G05.1.454.CMB.2.raw
  modified_base (204)..(204): a, c, t, g, unknown or other
  misc_feature (204)..(204): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagactaccaccggagaaattgtgttgacacagtctccagccacgctgtctttgtctccgaggggaaanagccaccctctcctgcagggccagtcagagttgttcgctacgtttcggttagggtggtatacaaacaataaacgtcccggcaggcctcccgaggcctcctctattctttgatcgtctttcaacgcggcccctggcctcccgaggctaggtcaggtcggngtaggtggggtcgtgggacctagtaccttcgctctccacctagtcacgctacgcccgtaaggacgtccgtagtaaacgttagtttttcgacgttaagtttttacttacgttacgttacgagtacgaacggtcgttacgtcccgtacgtttcggggacgggtacggtcgtccgtacggtttcgggacgggtaaacgggaaacctaaaagtacggtaacggtaaacctaaaacggtaacgtacggttacggtcgtacggaacccgtaccttaacgttcggttacgtttcctttacgtaactttccccg

SEQ ID NO: 305109 - DNA, 596 bp, Homo sapiens
  misc_feature: GZ8MTXP02FXPER.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtcctgagactctcctgttctgcgtctggattcatctttaagtaaatctggcatgtcctgggtcccgccaggttccaggcccacggctggaagtgggtgcagatatacaatatgatgacaagtaaaatgtaactagtaggagacttaccgtacgaaacgggccgaacttcaccactcctaccaaggaacaactaaattaccaaaagaaactagtagggttataagttctagaacaaaagtcgaaccagtacccaggagaacgcggaacggtaacgtacggggttatttaagttaacgtcggttaggggtaacgtaaacgttaccgtaaggtcggactacgtacctaccgttaggtatttacggg

SEQ ID NO: 305110 - DNA, 672 bp, Homo sapiens
  misc_feature: GZ8MTXP02H20RF.10.71.G05.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtgagtcgtgggggagcgtggtccggccggtgggggtccctgagctctcctgtctgcgtntggnttcatcttagaatctggctntgtccgtcgggtccncgtaggttcccaggccgacgggcgtggaaggtggggtgccgagatagtaacaatagtagntaggaactaaagttaaaatataactagtacgggtaacgtaccctaccgttacgaaacgggggtccctaatttaccctaaccttacttaccgtaccctaaggaaacgtaacctaaacgtttaaaccccgaaaaggtaaactagttaggggttaccttaattaccgaggtaaccaaaagttaccggaacccagtacccgttacggaaaggaccggaaccggtaacgggtaaccgtaacggggttttacgtttaagtttaccggtaaggttacggggaaaagttaacgttacgtacggttggtaacctacgg

SEQ ID NO: 305111 - DNA, 663 bp, Homo sapiens
  misc_feature: GZ8MTXP02JGKUN.10.71.G05.1.454.CMB.2.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtggggtcctgagctctctgttctgcgtctggattcatcttagtaatctggcatgtccgtgggtccnccagggttcccagggcccacggggctagggaatggggtgccagatatacgaatatgatgaactaagtaaaatntaactataggagtacttacccgttacaaacgggggtccctaatttaccaacccgtacttaccgtacccaagggtaacaaacctaaatttaccccgaaaaggtaaaccctaagttagggttaacgtaactacgttacggaacctaaaaattcggaaacccacgtacccgttaggaacggaacggaccccggaaagggtaaccggttaaccgggggttacgttttaacgttaaccgtgggttaacggggtaaagtaaaacgttcccgttaacggtacgggtaaccttaacg

SEQ ID NO: 305112 - DNA, 640 bp, Homo sapiens
  misc_feature: GZ8MTXP02I2XG8.10.71.G05.1.454.CMB.2.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaangccacctctcctgcagggccagtcagagtgttcgctacttcggtaggggtgtatcaacataaatccggcaggctcccaggctcctcatctttgatgtctttcaacgacggcccctggccgtcccgaggctaggttcagtggcaggtgggtctggggacagtaccttcactctacaccatcaagcacgcctagacgtcctaggaaagtnttttagaccttaaggttttacttaacgtgtacaggtcgaggtccgttcgtacccgtacggtttccggggaccgggtaggtcgtacccgttaacggtttcggggaccggggtaacgggtaaaaccctaaaaagtacgggaaacggttaacgaaaaaccggtaacgttcgggttacggcgttacgaacctaacccgtaattaccgtaggtttccttacgtaactttccccg

SEQ ID NO: 305113 - DNA, 714 bp, Homo sapiens
  misc_feature: GZ8MTXP02JMTZP.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggcgtgggggtccctgagactctctgttctgcgtctggattcattcttagtaatctggcatcgtccgtcggtcccgcgtacggttccgaggcccgaacggggtcgtgggtaaacgtggggtgacgaggtactataacaatagtgaattgactaaagttaaaatataacgtagtacggactaccttaccgttacgaaacggggtccctaattccaacctacttccgaccgaaaggaactaaactaaactttacccgaaaagtaaacctaagttaggggtaacttacgtaccttaaggaaccctaaaaagttcggaaaacccgaacggtacccgttaagggaaccggtaaccggacccggggtaaacgggtaaaccgggttaaaccgggggttttaagttttaaaaccgttaaccggttagggtaacgggggtaaaataaaccgttaccggtaaagggtcggtaacctaacgtaccgtttaaacccgg

SEQ ID NO: 305114 - DNA, 522 bp, Homo sapiens
  misc_feature: GZ8MTXP02IGJHN.10.71.G05.1.454.CMB.2.raw
  modified_base (180)..(180): a, c, t, g, unknown or other
  misc_feature (180)..(180): n is a, c, g, or t
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (434)..(434): a, c, t, g, unknown or other
  misc_feature (434)..(434): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagngatgtccagtgtcagatgcagatggtggagtcgtgggggagcgtggtccggccgtgggggtccctgagactctcctgttctgcgtctggattcatcttagtaatctggcatgtcctgggtccncaggttccaggccacgggctggaatggggtgccagatatacatatgatgacaagtaaaatntactatggagactccttacgaagggcattccaccatctccagagactaaattaccaaagaacatagggtntaatctagcaaatgaccagcctagagagcgaggacgtacgggtagtttagtacgtggtacgggaagtaacgtaccgtagtggactacg

SEQ ID NO: 305115 - DNA, 550 bp, Homo sapiens
  misc_feature: GZ8MTXP02FVDNO.10.71.G05.1.454.CMB.2.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcattcttagtaaatctggcagtgtccgtggggtcccgccgacggttcccaggccgacggggctgggaagtggggtgcagatanacaatangatgaacaagtaatntaactagtagatactccgtacgaaacggggcctattccaacctatcctacagaagaactaattacccaaagtaacagtggtatatctagacaatgaccagcagagagccgaggacgtacgggttattatacgtaggtacggaagtaaactcgtagacggctagtcgacgttggttacg

SEQ ID NO: 305116 - DNA, 664 bp, Homo sapiens
  misc_feature: GZ8MTXP02JE99N.10.71.G05.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgctacgttcggtagggtgtatcaaacataaagtccggcaggcctccaggctcctnatctttgatgtctttacacgacggcccctggcctcccaggctaggttcaggtggctaggtgggtctagggactagtaccttcacttctacaccgatccgagccacgtacccgtaagacgtacccgttaggaaacgttagttttacggacgtttaacgtttttaacttaaccgttgttaccgaacgggtactaacgggtccggttacgtacccttacgggtttaccggacggggtaacgggtcgtacccgttacggtttaccggggacggggtaaacgtaaccgaaaaagttacggaaacggttaaccgaaaacgtaacgtcggtacgcgtacgaaccgtactacgtcgtcgtaccttactaccgtttcccg

SEQ ID NO: 305117 - DNA, 588 bp, Homo sapiens
  misc_feature: GZ8MTXP02H792D.10.71.G05.1.454.CMB.2.raw
  modified_base (452)..(452): a, c, t, g, unknown or other
  misc_feature (452)..(452): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggtattcattctttagtaatcgtggctagttcgtccgtcggggtcccgcctacgggttcccgagggtcccgacgggcgtagggaacgtggggtggccgagagtataacaatattgatagaactaaagtaaaatatactagtgacgtactaccgttgaaggcccgtattaccactatctaccganacgaaaccaattaacccaaagaactagtgggtagttactcgtagacaaatcgaccagccctagagacgcggaacggacgtacgggttagtttagtacgtaaggttacggaaagtactaccgtaggtcggactaccg

SEQ ID NO: 305118 - DNA, 681 bp, Homo sapiens
  misc_feature: GZ8MTXP02GD8QX.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtggggtcctgagctctctgttctgcgtcgtggattcattctttagtaaatcgtggctagtcgtccgtcgggtcccgccgtacggttcccgacgggcccgaacggggtctaggggtaacgtggggtcggaccagtataacgtaacgtaaatacgtagatacgaaacgtaaagttaaaaactataaacgtaagtagggaactaccttacccgttacgaaacggggtaccctaattacccaacctaatcccgtacccgaaagtaactaaacctaaacttaacccgaaaagtaaaccgtagttacgggttataacgttaccgtagaactaaaacgtcgaaccgtacgtccgtaggacggacggaccgggaacggtaacggtacgggtttagtttaacgttacgtaagggttacgggaaataaacgttccgtaaggtcggactaaccgg

SEQ ID NO: 305119 - DNA, 694 bp, Homo sapiens
  misc_feature: GZ8MTXP02JA77F.10.71.G05.1.454.CMB.2.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtctccgaaggggaaancgccaccctctcctgcagggccagtcagagtgttcgctacgttggttaggggtgtatcaactataaacgtccggccaggcctacccgaggtcctcctctattcgtttgatcgtctttacaacgtccgggcccctgggcccgtacccgaggtctacggttcaggtcgggactacggggtcggggtccgtaggggaactaggtacctttcgaccgttctaccaaacctacgtccaaggtccacggtaccctaaggaccgtccgttaaggtaaacgttattttcgacttaaggttttactacgttgtacgagtcgtacggtcgtcgtaccgttacggtttcgggacggtacgggtcgtcccgttacggtttcggggaacggtaacgggaaacctaaaaggtaggaacggtaaaccgtaaaacggtacgttcggacggtaccgtaggaacccttaacgtacgttccgtacgtttccttaacctactttccccg

SEQ ID NO: 305120 - DNA, 679 bp, Homo sapiens
  misc_feature: GZ8MTXP02H4LMO.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcggtggtccggcgtgggggtcctggagctctcctgttctgcgtctggattcatctttagtaaatctggcattcgtccgtcgggtccgccgtaggttcccaggccgacgggcgtagggaacgtggggtgccgagtactaataacaattagtagatagaacgtaaagttaaaaatactaacgtaataggacgtacccttccttacggaaacgggcccgtactttaccaaccgtacttcccgaaccaggaactaaactaaacttaaccaaaaggaactaagttgggttataacgttaccaggtaacaaaacgttaccgaaccgacgacccggttaaggaaccgggtaaggaccccggaaaggggtaaccgttaccggggtttaattttaacggtaaccgttaaggggtaacggggtaaaacgtaaaacggttccgttaagggttacggtaccttaaccgg

SEQ ID NO: 305121 - DNA, 633 bp, Homo sapiens
  misc_feature: GZ8MTXP02G52EH.10.71.G05.1.454.CMB.2.raw
  modified_base (385)..(385): a, c, t, g, unknown or other
  misc_feature (385)..(385): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcggtggtccggcgtgggggtccctgagctctctgttctgcgtctgtattcattacttaagtaatcgtggctagttcgtccgtcgggtcccgccgtacgggttcccacgggcccgacggggtccgtagggaagtggggtggccgaagataataacaattagngagttagaaactaaagttaaaatataactagtacggatacctaccgttacgaacgggtcctaattacaccctatcctaccaagacaaactaacttaaccgaaagtaactagttagggtataacttcgtacgaaactaaagtccgaaccgacgtacctaggaacgacggaccggaaaggtaccggttacggggttactttagttaacggtgggtaaggaaacgtaacttccggtaggtacggactaacg

SEQ ID NO: 305122 - DNA, 559 bp, Homo sapiens
  misc_feature: GZ8MTXP02HW06C.10.71.G05.1.454.CMB.2.raw
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcgtggtccggcgtgggggtccctgagacttctcctgtctgcgtctggattcattcttaagtaaatctggctatgtccgtgggtcccnccgtaggttccagggccgagggctggaagtgggtgcagtatagtaacatatagactgactaagtaaaatntactagnggatactcttacgaggcattcaccntccncagacataataccaagaactagtgtagtatactagacaaatcgaaccagtaccgtgaacgacggaccggaggtacgtaacggggttatttaacgtacggtggtaacgggaaagtaacgtacgtacggtacgactaacgtctaacgg

SEQ ID NO: 305123 - DNA, 643 bp, Homo sapiens
  misc_feature: GZ8MTXP02GK49E.10.71.G05.1.454.CMB.2.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccgaggggaaangccacctctcctgcagggccagtcagagtgttcgctacgttcggttagggtgtatcaaacataaatccggcaggctccaggcctcctcatcttgatgtctttcaacgcgggcccctggccgtcccgaggctagggttcaggtggcgaggtcggggtctgggacagtacttcactcncaaccatcagcagcctagacnctagaagttntttcgactagttttatacttgacagacaggtccgtcgtaccgtacgtttcgggcggtacgtcgtaccttacggttcgggacgggaaacgggaaacctaaaaaggtacggtaaacggttaaaccgaaaaacggtaaaccgttcgggtaacggtaccgttacgggaaccctaaacccggtttaattaccccggttttacgtttacccgtttaccgtaccgtttaccccgttaccccg

SEQ ID NO: 305124 - DNA, 534 bp, Homo sapiens
  misc_feature: GZ8MTXP02HRZCB.10.71.G05.1.454.CMB.2.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (453)..(453): a, c, t, g, unknown or other
  misc_feature (453)..(453): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttacttttaagagatgtccagtgtcagatgcagagtggtggagtcgtgggggagcggtggtccggcgtgggggtccctgagctctctgttcngcgtncggattnatcttagtaatctggcatgtccgtgggtcccncgacggttccacgggcccgacgggctaggaagtggggtgccgagatataacaatatgatagaataaagtaaaatatactaagtgaacgtactacgtagaacgggcatacgacatcgaccagagaacataccaatacatgggatacntagacaagtcacagcctagagcgacgagaccgtacggttacttagtacgtaaggtaggaataacgtcgttagcggtacacg

SEQ ID NO: 305125 - DNA, 614 bp, Homo sapiens
  misc_feature: GZ8MTXP02FIZKP.10.71.G05.1.454.CMB.2.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtcttttgtctccgaggggaaangccaccctctcctgcagggccagtcagagtgtcgctacttcggttaggggtgtatcaacataaatccggcaggctcccaggctcctcatctttgatgtctttacaacgacgggcccctggccgtccccgaggcgaggttcaggtcggcaggtcgggtctggggacagacttcnctctcaccatcagcagcctagacgtctagaagtattttgacttaagtttacttactacgttcaacgcaggtccggtcgtccctacggtttcgggcgggtaggtcgacccgtacggtttccgggacgggtaacggggaaccaaaaagttacggaaacgggttaacgaaaaccggtaacgtacggtacggctaggaacccgacctaacttccgtacgttaccttacgactttaccccg

SEQ ID NO: 305126 - DNA, 732 bp, Homo sapiens
  misc_feature: GZ8MTXP02FT0OK.10.71.G05.1.454.CMB.2.raw
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgttctttgtcctccgaaggggaaagcgcccaccctctcctgcgagggccagtcagagttgttcnctacgttcggttagggtgtatacaaacataaacgtcccggcaggcctcccgagcctcctnattctttgatcgtctttacaacgtccggcccctggcctcccgaggctaggttcgagtggcgtaggtcgggtcgtaggggactaggtaccttcactctacgaacctgtcaacgccaacgtaccgtacgacgtccgtaagtaacgtttagttttacgagtttaagttttactttacgttagtacgtaacgtacgtacggtacggttacgtcccgttaccgggtttaccggggtaccgggttaacgggtcggtacccggttaccgggtttaccggggaaccggggttaaaacgggaaaacccgtaaaaggtaacgggtaaacggttaaaccggtaaaaaccggtaacggttacggttacgggtacgttaccggaacccgtacgttaaccgttcggtttacgttaccgtttacctaaccttttacccccg

SEQ ID NO: 305127 - DNA, 596 bp, Homo sapiens
  misc_feature: GZ8MTXP02JEGYG.10.71.G05.1.454.CMB.2.raw
  modified_base (203)..(203): a, c, t, g, unknown or other
  misc_feature (203)..(203): n is a, c, g, or t
  modified_base (409)..(409): a, c, t, g, unknown or other
  misc_feature (409)..(409): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccacctctcctgcagggccagtcagagtgttcgctacttcggttagggtggtatcaacataaatccggccaggcctcccgaggcctcctcatctttgatgtctttcaacgcggcccctggccgtcccaggcaggttcaggtggcaggtcgggtctgggacagacttcactctcacctatcagcagccctagacgcctagaacgtnttttagctagtttattactgtctagctaggtacgtcgaccgtacggtttcggacgggacggttcgacccgtacggtttcgggaccgggtaaggggaacctaaaagtacggaacggtaacgaaaacggtaacgtcggtacggtccgtggaacctacgtaactccgtacgttccttacactttaccccg

SEQ ID NO: 305128 - DNA, 587 bp, Homo sapiens
  misc_feature: GZ8MTXP02G6VWW.10.71.G05.1.454.CMB.2.raw
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (482)..(482): a, c, t, g, unknown or other
  misc_feature (482)..(482): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggccgtgggggtccctgagactctcctgttctgcgtctggattcattcttagtaatctggcatgtccgtggtccgcctaggttccaggtccgacggggtctagggaatggggtgaccagactanacgaatangatagaactaagtaaaaatntaactataggagactcccgttacgaagggacccgtattacaccacttcctaccaagacaaactaacttaccaaaagtaactaattagggtataccgtnttagacaaaagtcacgaacgtccagacgagaccggaggaccgtaggggttactttattaacgtggttaggggaaacgtaattaccgtaaggttcggaccgtaacg

SEQ ID NO: 305129 - DNA, 549 bp, Homo sapiens
  misc_feature: GZ8MTXP02H1TKX.10.71.G05.1.454.CMB.2.raw
  modified_base (335)..(335): a, c, t, g, unknown or other
  misc_feature (335)..(335): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcgttgggttttcctcgttgcttcttttaagagatgtccagtgtcagatgcagatggtggagtcgtgggggagcgtggtccggcgtggggggtccctgagactctcctgtctgcgtctggattcatcttaagtaaatctaggcatcgtcgtcgggtccgctaggtccaggccacgggctaggagtgggngacagtatataacaatatagatagaataaataatataatagtagactactctagacgactataccactactcacaagaacaactaactacaaatatagtagtatanacgtananaanacacacgacgagacgacgacgacgaacgacgtacgttagttacgttacgtacggtaggtaagtaacgtacgtacgtacgacgtactacgtacgtacg

SEQ ID NO: 305130 - DNA, 576 bp, Homo sapiens
  misc_feature: GZ8MTXP02FGALQ.10.71.G05.1.454.CMB.2.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccagggaaanagccaccctntcctgcagggccagtcagagtgttcgcacttcgttagggtgtatcaacataaatccggcaggctcccaggctcctcatctttgatgctttcacnggcccctggcgtcccaggcaggttcagtggcagtgggtctgggacagaccttcnctctcacatcagcagcctagngcctagaagtattttgcttagtttatactgtcagcagcgtgcctacgtttcgggcggtaggtcgacccgtacgttccggggacgggtaacgggaacccaaaaagtacggaacggtaccgaaaaccggtaaacgtcggtcgggccttacggaaccgaacccgtacttccgttcggttcctttaccctacgttccccg

SEQ ID NO: 305131 - DNA, 712 bp, Homo sapiens
  misc_feature: GZ8MTXP02GIYQ1.10.71.G05.1.454.CMB.2.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagttgttcgctacgtttcggttaggggtggtatacaaactataaactcccggcaggcctcccgaggcctcctnattctttgatgtctttacaacgtccgggcccctggcccgtcccgaggtctaggttcaggtggcaggtgggtctaggggactagacctttcaccgtctaccaacctatccagtccacgtacccgtagacgtcctaggtaaacgttagtttttagcctttaaggttttaacttaccgttagtacgtaagtaccgtaacggtccggttcgtacccgttaacgggttttccgggaccggggttaggttccggtacccgtttaaccgggtttccggggaaccgggtaaacgggaaaacccgtaaaaaggttacgggaaacggttaaaccgaaaaacggtaacgttcgggtacgggtacctacggaacccgtaaccgtaacttccggtacgttaccttacctaaccgtttccccg

SEQ ID NO: 305132 - DNA, 683 bp, Homo sapiens
  misc_feature: GZ8MTXP02IFLJD.10.71.G05.1.454.CMB.2.raw
  modified_base (270)..(270): a, c, t, g, unknown or other
  misc_feature (270)..(270): n is a, c, g, or t
  modified_base (629)..(629): a, c, t, g, unknown or other
  misc_feature (629)..(629): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggaggcggtgggtccggcggtgggggtccctggcgtactctcgtgttcngcgtctgacttcattcgtttaagtaaatcgtggactattcgtccgtcggggtccccgaccgtacgggttcccgacggggtccccgacggggtcgtacggggtaaaggttcgggggtacggaccccgaaaggtaattaacgtaaactaaagttaagtcgtagttaggaaactaaaaggttaaaaactataactaagtaggaactaccttccgttaacgaacgggtccctaattcccaacctactcctaccgaagaacgaaactaacgttaacccaaagtaaactagtggtatagtcctagaactaaagtacgaaccgtagacctaggaacgacggaccggaaacggtaccgtacgggttntttaaaccgttagtggggtaaggaaacgtaacttccggaaggtacgacttaccg

SEQ ID NO: 305133 - DNA, 593 bp, Homo sapiens
  misc_feature: GZ8MTXP02HBDQ1.10.71.G05.1.454.CMB.2.raw
  modified_base (377)..(377): a, c, t, g, unknown or other
  misc_feature (377)..(377): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcattctttaagtaaatctggctatcgtccgtgggtcccgcgtaggttcaaggccacggggctggaagtggggtgctagagtatactaatatgatgacaagtaaaatntaactataggaatacctaccttagaaacgggtccaattaccacctaatcctaccaagaacactaacttaaccaaagaactagtggtatactctagacaaagtcgaaccagacctggaacgacgacccggaaggaccgtaggggttacgtttaagtaacgtgggttaaggaacgtaaaacgttccgttaaggtacggacctaagtaccgttaaccgg

SEQ ID NO: 305134 - DNA, 727 bp, Homo sapiens
  misc_feature: GZ8MTXP02JT3JH.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgtcttcttttaagagatgtccagtgtcagatgcagagtgggtggaggtcggtggggggaggtcggtgggtcccgggccggttcggggggtccctggacgtcctctccgttggttcgtgtcgtcgtggtacttctattactttaagtaaactcgtggctagtcggtccggtcggtcccgccgtacggtccgacgggtccgacgggcgtgggaggtcggggtggaccgagtatataactaatagtgtatagaaactaaagttaaaatagttacgtaagtacggacttacccttccgtaacggacgggacctacttacacctactacccgtacgaacgacgtaaaccctaaacgttaaccccgaaaggtaacttaaggttggggttaactaacgtttaccgaacggttaactaaaacgttccgaaaccgtaccgtaaccggtagggaaccggtaccgggaacccgggtaaggtaaccgggtttaccgggtttagttttacggttaaccggtaaggggtaacggtaaacgtaacgttacggtacggtacggacttaaccggg

SEQ ID NO: 305135 - DNA, 728 bp, Homo sapiens
  misc_feature: GZ8MTXP02HDS5V.10.71.G05.1.454.CMB.2.raw
  modified_base (402)..(402): a, c, t, g, unknown or other
  misc_feature (402)..(402): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagtcttgggttttccctcgttgcttcttttaagagatgtccagtgtcagatgcagagtgggtggagtcggtgggggaggtcggtcgggtcccggtccggtcggggggtcccctggacgtacctccttccgtgttcgtcggtcgtcgtggtacttctatttactttaagtaaattcgtggtctagtcggtccgtcgggtcccgccgtacggtccgacgggccgacgggtctagggtagtggggtgacgagataanactaatatagaatagactaaagttaaaatataacgtagaggaacgtaccttaccgtacggaacggtcctacgttaccaacctactccacaaggtaaacaactaaaccttaacgaaagtaaactaggttacggtattaacgtacgtaagaacctaaagtcgaaccacggtaccgaaggaaccggaacggaccggggtaaaggtaaccccggttaaaggggtttacgttttaaacggttaaccgggttacggggtaaaagggtaaaaccgtaaaacggtttaccccggttagggtaaccggtactaaccgttaccggtttaaaccggg

SEQ ID NO: 305136 - DNA, 603 bp, Homo sapiens
  misc_feature: GZ8MTXP02IXNBU.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcggtggtccggccgtggggtcctgacgctctcctgttctgcgtctggattcattcttagtaatctggcattcgtccgtcgggtcccgccgtacggttcccgacgggcccgacgggctgggaagtggggtgccgagtatataacaattatagagtacgaactaaagttaaaatataactagtacgggaactacttacccttacgaacggggtccctaagttaccaacctagtcctaccgagacgtaaactacttaaccaaagtaactagtggtatactcgtagactaaagtcgaacctacgccgtaggacgacggaccggaggtacgtacggggttatttacgttacgtggtaggaacgtaacgtcgtaggtcgactacg

SEQ ID NO: 305137 - DNA, 642 bp, Homo sapiens
  misc_feature: GZ8MTXP02JZWJM.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtccctgagctctcctgttctgcgtctggattcattctttagtaaactctggctagtcgtccgtgggtcccgccgtacgggttcccacggccgacggggctagggaacgtggggtggccgagatataacaatatgatagaaactaaagtaaaatattaactaagtagggaacgtaccttccgttacgaaacggggtccctaatttaccgaaccctagttacctaccgagaacgtaacctaaacttaccgaaaagaactagttacgggtattactcgttaaggaactaaagtccgaaccgtacgcccgtaggaacggacggaccggaaggtaaacggtacggggtttagtttaacgtttacgtaagggtaaggggaacgtaaacgttcgtacggtacggactaacg

SEQ ID NO: 305138 - DNA, 535 bp, Homo sapiens
  misc_feature: GZ8MTXP02HQT7B.10.71.G05.1.454.CMB.2.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccagggggaaangccaccctctcctgcagggccagtcagagtgttcgctacttcggttaggggtgtatcaacataaatccggccaggctcccaggctcctnatctttgatgctttcaacaggcccctggcctcccaggcaggttcagtggcaggtgggtctggggacaggacttcnctctcaccatcagcagcctagacgcctgaagtattttgactagtttattactgtcagcagcgtgcctacgtttcggcggtaggtcgccgtacgtttcgggacggtagggaaccaaaagtagaggtacaaacgactgtcggactgaacacacgtctacgtctactactcc

SEQ ID NO: 305139 - DNA, 646 bp, Homo sapiens
  misc_feature: GZ8MTXP02JPR49.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtcgggggtcctgagctctcctgttctgcgtctggattcattctttaagtaaatctggctagtcgtccgtcggccgcgtacggtccgcggccgacgggtcgtaggtaggtcgggtgacgagtataactaataatagtagagtacgaagtaaaagtaaaacttataacgtagtaacggtaactaccttaccgtacgggaacggtaccctactaccaacctactccctaacgaacgtaacaactaactaacgaaagtaaacgtgtagttatactacacgaaactaacgtaccgacgacgaccgtagaacggaccggacggaacggtaccggttagggttaacgtttaccgtacggttagggaacggtaaacgtaaccgttacggtacggtacgtaccgtaactaccgtttaacggg

SEQ ID NO: 305140 - DNA, 754 bp, Homo sapiens
  misc_feature: GZ8MTXP02IF4IO.10.71.G05.1.454.CMB.2.raw
  modified_base (279)..(279): a, c, t, g, unknown or other
  misc_feature (279)..(279): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatgggtggagtcgtgggggacggcggtgggtccgggccggtggggggtccctggacgactctcctgttctgcgtcnggattccattcttagtaaatctggctatcgtcccgtcggggtcccgccgtaacgggttcccacgggcccgacggggtcctaggggtaagtcgggggtcggacccgaggtaactataacaaattatagatagaaactaaagttaaaaattataacgtaagtaggtaacgtacccttacccgttacgaaacgggggtaccctaactttacccaaacctacttaccctaacccgaagtaaacggtaaacctaaaacctttacccgaaaaggttaaaaccaaggtttacggggttattaacgtttacgacgtaaacccgtaaaagttacccggaaacccgtacgaccccgttaaggaacggaacgggtaacccggaaacgggggtaaccgttaacccggggtttagtttttaaccgttacggttaagggttaacggggaaagttaaaacgtcccgttaaaggtccggttaacgtaaccg

SEQ ID NO: 305141 - DNA, 547 bp, Homo sapiens
  misc_feature: GZ8MTXP02F2S7U.10.71.G05.1.454.CMB.2.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcgtggttttccgtcgttagctctttaagagatgtccagtgtcagatgcagatggtggagtcgtggggaggcgtggtccggcgtgggggtccctgagactctctgttctgcgtctggatcatcttagtaaatctaggcatgtccgtcggtaccnccgtaggttccaggccacggggctaggaaagtggggtgacgagataataacaataatagatagaanaaataaaataataatagtagacgtactactacgaacggacgtactactacatactacagaacgaacaactaacaaacgaaatagtagtagtatatananaanacacacgacgagagacgacgacgacgtacgttacgttactacgtagtagaagaactactacgtagacactactacg

SEQ ID NO: 305142 - DNA, 550 bp, Homo sapiens
  misc_feature: GZ8MTXP02J11LG.10.71.G05.1.454.CMB.2.raw
  modified_base (299)..(299): a, c, t, g, unknown or other
  misc_feature (299)..(299): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtgggtccggccgtggggggtcccctgagactctcctgttctgcgtctggattcatcttagtaaatctggcatgtctgggtccnccaggttccaggccacgggctggaagtggggtggcagatagtacaatatgatgacaagtaaaatatactatggagactcttacaagggcctattcacctatctacccagagacctaattaccaaagaacagtggtatagtctagacaaatcgaacctacgctagagacgaccgaggacgtacgggtgtttaatacgtaggtagggactaaaactccgtaaggtcggacacgtctaccgtggttaacttcgg

SEQ ID NO: 305143 - DNA, 668 bp, Homo sapiens
  misc_feature: GZ8MTXP02JTSD7.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtgggtccggccgtgggggtccctgagctctcctgttctgcgtctggattcattcttagtaactctggctattcggttccgtcgggtcccgccgtacgggttccacgggtcccgacggggtcgtagggaagtcgggggtaggacccgtaggtattaactaacgtaattagtggtattacgaaataaaggttaaaaattataactaagtagggtaaacgtaccctttacccgttaccggaacggggtacccgtaacttaccacctactacctacccaagacgaaactaattacccaaagtaactagttgggtactaacttcgtacgaacaaattaccggaaccacggtcctaggaacgtacggaccgagggtacccgtaggggtttacgtttaagttacggtaaggtaggtaaacgtaacgttccgaggtttccggattaccgg

SEQ ID NO: 305144 - DNA, 644 bp, Homo sapiens
  misc_feature: GZ8MTXP02IO6JV.10.71.G05.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaangccacctcncctgcagggccagtcagagtgttcgctactttcggttaggggtgtatcaanataaanccggcaggcctccagctcctcattctttgatgtcttacaacgcggcccctggcctccgaggcaggttcaggtggcaggtgggtctggggacaggtaccttcactctacaaccatccaagcaacgcctaagacactaggtaagttattttgacttaagtttacttaactcgtactagacgtacgtcgttcgacccgttacgtttccggggacggtacgggtcgtcccgttacggtttccggggacggggtaaacggaaacccgtaaaaggttaacggaacggttaaccgaaaaaccggtacgttacgggtcggaaccgttacggaaccctaacgtacgtttaccgttacgttaccctttacgtacctttacccccg

SEQ ID NO: 305145 - DNA, 694 bp, Homo sapiens
  misc_feature: GZ8MTXP02IOEWD.10.71.G05.1.454.CMB.2.raw
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccgacgtgggggtcctgagctctcctgttctgcgtctggattcattcttagtaaatctggcatgtcctggtccaccgtggttccaggccgacgggctgggagtgggtgcagatataaccaatatgatagaacaagtaatataactataggacgtacttcccttacgaaacggtccgtaattaccaacctatccctacccaagaactaactaaacttaccaaaagtaaacctaagtttagggttagtttaatacgttacgaacctaaaaagttccgaaacccgtacggtacccgttagggaaacggaacggtaccccgggaaaagggtaacccgggtttaaccgggggtttagttttttaaaaccggttacggtttacggggtaagggggtaaacgttaaaaccgtttaacccggttaagggttacgggtaacctaactttacccgttaacccggtttagggtttttaaaccgg

SEQ ID NO: 305146 - DNA, 640 bp, Homo sapiens
  misc_feature: GZ8MTXP02ITBVP.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcggtgggggaggcggtgggtccgggccggtggggggtccctggacgtcctctcctgttctgcgtctggattcattctttaagtaatctggctagttcgtccgtcgggtcccgccgtacggttcccgacgggcccgacgggcgtagggtaagtggggtcgaccgaagatataactaattagtagatagaaactaaagtaaaattataacgtagtaggaactaccttccgttacgaaacgggtcctaacttaccaacctacgttacctaccgaagaacgtaactaaacttaaccaaagtaactagtggttactatcagtacaaaactcgaaccagtaccgtaggacgaacggaccggaaagggtacgttacgggtttacgtttaagtacgttaagggtaggaaactaacgtccgtagtcggacttaacg

SEQ ID NO: 305147 - DNA, 629 bp, Homo sapiens
  misc_feature: GZ8MTXP02FUTKS.10.71.G05.1.454.CMB.2.raw
  modified_base (371)..(371): a, c, t, g, unknown or other
  misc_feature (371)..(371): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcgtggtccggccgtggggtccctgagactctcctgttctgcgtctggattcattctttaagtaaatctggcattgtccgtgggtcccgcgtacggttccagggcccacggggtctgggaatggggtggaccagataataacaattanagtatgaaactaagttaaaaaattataactaagtggaactaccttacccttacgaaacggtccgtaatttaccacccgtaatcctaccaacgagaaacctaaacttaccgaaaagaactagttacgggtagtaacttcgtagactaaaacgtcgaaaccgagacccgtagacggacggacccggaaggtaacgtaccggggtttagtttaacgttacgtaagggtaggtaaagtaaacttcgtaaggtcggactaacg

SEQ ID NO: 305148 - DNA, 645 bp, Homo sapiens
  misc_feature: GZ8MTXP02H3ZUP.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtgggtccggccggtggggggtccctggacgactctcctgttctgcgtctggattcattctttaagtaatcgtggctagttgtcccgtcggggtcccgccgtacggttcccgacgggccgaacggggtcctggggtaacgtggggtggccgaggtaatactaacaatagtagatagaactaaagtaaaatatactagtacggacgtactccgttaggaacggtccgtattaccacctataccctaccgaagtaacgaaacctaaacgtttaacccaaaagtaaacctagttaggggtacttaacgtcgtaacgtaactaaaacgtccgaacctagtaccgtaggacggacggtaccgagggtaacgtacgggttatttaacgtagtaaggtaggaaacgtactacgtggtacgacttacg

SEQ ID NO: 305149 - DNA, 632 bp, Homo sapiens
  misc_feature: GZ8MTXP02HBINV.10.71.G05.1.454.CMB.2.raw
  modified_base (262)..(262): a, c, t, g, unknown or other
  misc_feature (262)..(262): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttcngcgtctggattcatctttagtaatctggcatgtcctgggtccgccgtaggttcccaggccgacgggtctggaagtggggtgccagatagacaatatgatgaactaagtaaaatataactagtaggaactaccttcccgttacgaacggggtcccgtaatttccgaacccgtattccctacccgaagtaacgaaactaaactttacccgaaacggtaaatacgttagggtagtaactacgtacgaactaaaagttcgaaccctagccctaggaccggacggacccgaaggggtaccgtacggggtttagtttaacgttaaccggtggtaggggtaaacgtaaacgttccgtaggttacggactttaaccgg

SEQ ID NO: 305150 - DNA, 619 bp, Homo sapiens
  misc_feature: GZ8MTXP02HETK1.10.71.G05.1.454.CMB.2.raw
tcagcatagtagtgcacgaccggtgctcgatttagtgtcgtcgcaagagagaggggggctctgggagaggagcccagcactagaagtcggcggtgcctccattcggtgatcagcactgaacacagaggactcaccatggagtttgggctgagtcttgggttttcctcgttgtcttcttttaagagtatgtccagtgtcagatgcagatggtggagtcggtgggggaggcggtggtccgggccggtgggggtccctggacgctctctgtctgcgtcgtggtattctattactttaagtaaactcgtggctagttcggttcccgtcgggtccccgccgtacggttcccgaggcccgacgggcgtagggaagtggggtgacagtataatacaatatagaattgaaactaaagtaaaatataactagtaggactacctaccgtacgaacgggtacctattccacctacttccaccagaacaactaactaccaaagaactagtaggtagaatctagaactaaatcgaaccacgaccgtaggacgaccggacggaacggacggttacgggttatttaacgtagtaggggtaaggaactaacgtccgtaaggtcgactaagtcccg

SEQ ID NO: 305151 - DNA, 725 bp, Homo sapiens
  misc_feature: GZ8MTXP02IXQBM.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagtatgtccagtgtcagatgcagagtggtggtagtcggtgggggaggcggtggtccggccgtcgggggtccctgacgctcgtcctgttctgcgtctggtacttctatttacttagtaatcgtggctagttcgtccgtcgggtccccgcgtacggtccgacgggcccgacggggtcgtaggtagtggggtcgaccgagattaataacgtaatagtacgtagtagaaacgtaaagttaaaatactaacgtagtaggacgtacttcccgtagaacgggtaccctaagttaccacctatacctaccgaacgaacgtaaacctaacttaaccaaaacggtaacttaggttacgggtattaaccgtacgtaggaaaccctaaagtaccgaaccgtacggtccgtaaacgggacgggaccggaccgggtaaaccggggtaacgggtttaaccgggggttttaagtttttaacggtttaccggttaagggggtaacggtttaaaacggttaaacccggtaccggtttaaggtaccgggtaacctttaacccgg

SEQ ID NO: 305152 - DNA, 694 bp, Homo sapiens
  misc_feature: GZ8MTXP02GJ0PO.10.71.G05.1.454.CMB.2.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
  modified_base (637)..(637): a, c, t, g, unknown or other
  misc_feature (637)..(637): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgttgggttttcctcgttgcttcttttaagagtatgtccagtgtcagatgcagagtggtggagtcggtgggggaggcggtcggtccggccggtcgggggtccctgagtctcgtctgttcngacgtntgnttctnttactttaagtaatcgtggactacgttcggtccgtcgggtcccgccgttaggtccccgagggcccgacgggtcgtaggaaggtggggtacnccgaagtaactataactaagtagtagagtagaaactaaaagttaaaactactaacgtagtaacggtacgtacccgttaccgttacggaaaccgggtactacgttacccactactacctacgaaagacgtaaacctaaaccttaaaccgaaacgtaaacgtagttagggtaacttactagttacgaaaccggtaaattccgaaacccgtagacccgtaggaacggacgggtaacccgtagggtaaaccgttacggggtttntttaacggttaagtaacggtaaagggtaaactacgtagtaccggtagtactaaaccg

SEQ ID NO: 305153 - DNA, 608 bp, Homo sapiens
  misc_feature: GZ8MTXP02FWAU0.10.71.G05.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaangccaccctncctgcagggccagtcagagtgttcgcacttcgttagggtggtatcaacataaatccggcagctccagctcctnatcttnatgctttcaacncggcccctgggcctcccgaggcgaggttcgagtggcaggtgggtctggggacagacttcactcacacatcagcagcctagagcctagtaagtacgttttagcttaagtttacttaacgtgtactagtacgtaagtcgtcgtacccttacgtttccgggacggtaggtcgaccgtacgtttccggggacgggtacgggaaaccgtaaaaagtacggtaaacgggtaacgaaaacggtaaacgttacgtacgggtacgtacggaacctaacccgtagttaccgtggttacctttaccgactttcccccg

SEQ ID NO: 305154 - DNA, 822 bp, Homo sapiens
  misc_feature: GZ8MTXP02GGM48.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgctcttttaagagatgtccagtgtcagatgcgagtagtgggtaggtagtcgggtgggggacggtcggttcgggtcccggtcgggttcgggggtccctaggtacgtaccttccttccgttcgttcgtcgtcgtcgtggtacttcgtactttactttaagtaactcgtggctagtcggtccgtcgggtcccacgtacgtccgacggtccggacgggtcgtaggaggtggggtgacgaagtaattaagtaactaagttagtgtaatagaaactaaaagttaaaactagttaactaggtaacggtacctaaccgtttaccgtaacgtaaacggggtacccttacttacccgaacctacttcccgtaaccgaagtaaaccgtaaaccttaaaaccgttaaccgaaaagtaaaccgttagggttaagggttattaaccgtttacggaagtaaaacccgtaaaggttacccccgaaaacgtcccggtccgtaaagggaccggtacccggggaaacggtacggggaaaccgggtttacggggtttttaaagttttaaacgttaacggggttacggtaaaggggtaaaacgttaaacccgtttccggtaagggtttcggaaccttacgggttaaccccttacgggtttaggtttaaacggttttaccgggg

SEQ ID NO: 305155 - DNA, 574 bp, Homo sapiens
  misc_feature: GZ8MTXP02JIOEA.10.71.G05.1.454.CMB.2.raw
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtccctgagctctcctgttctgcgtctggattcattctttaagtaaatctggcattcgtccgtgggtcccncctaggttcccagggcccaacggggctggaatggggtgccagatatacatatgatgaactaagtaaaatntactatggaatacctccgttacgaacgggtccgtaattaccacctatctaccagacgaactaacttacaaagaactagtgtagtaatttgactaaatcgactagcctagacgacgaccgaggaccgtacgggttagtttaacgtacgtaggtaaggaacgtaaacgttccgtaagttcggacctattaacccgg

SEQ ID NO: 305156 - DNA, 659 bp, Homo sapiens
  misc_feature: GZ8MTXP02HJG72.10.71.G05.1.454.CMB.2.raw
  modified_base (257)..(257): a, c, t, g, unknown or other
  misc_feature (257)..(257): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtggggggaggcggtgggtccggccggtgggggtcctgganctctcctgttctgcgtctggattcattctttagtaaactctggctagttcgtccgtcgggtccgccgtacggtccgagggccgacgggctgggaagtggggtggccgagtatatactaaatagtagatgaaactaaagttaaaattattactaagtaggaactacctccgttacgaacgggtcccgtaattaccgaacctacttcctacccaagaacgaactaaaccttaaccaaacgtaacagttaggttacgtatacgtagaactaaactcggaaccacggacctggaaacggagacccgggtaacgggaaccgttaacgggtttacgttttaacgttacggttaacggggtagggtaaacgtaaaacgttaccgtaaggttcgggtaacctttacccgg

SEQ ID NO: 305157 - DNA, 691 bp, Homo sapiens
  misc_feature: GZ8MTXP02JKVKA.10.71.G05.1.454.CMB.2.raw
  modified_base (376)..(376): a, c, t, g, unknown or other
  misc_feature (376)..(376): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcgtgggttttcctcgttgctcttttaagagatgtccagtgtcagatgcagatggtggaggtcgtgggggaggcggtggtccggcgtgggggtccctgacgctctcctgttctgtcgtctggtattcattcttaagtaatctggcatcgtccgtcgggtcccgcgtacggttccacgggccgacggggctggtacgtggggtgacctagtatataacgtaatagngtatacggaataaagttaaaaatacgttactaagtaggaacgtaccttacccgttacgaaacggggtcctacttaaccacctactaccctacgaaagtaacaaacgttaactaaccgaaacgtactaggttacggttatacgtactagtaaccgtaaattcgaaccgtaacgccgttaaagggacggaaaccggaccgggtaaacgggaacgggtttaaccggggtttaacgtttttaacggtacgggttaaacggggtagggtaaaacggttaaaccgtttccgggtaaacggttacggaaccctttaaacggg

SEQ ID NO: 305158 - DNA, 646 bp, Homo sapiens
  misc_feature: GZ8MTXP02JUS38.10.71.G05.1.454.CMB.2.raw
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaancgcccaccctctcctgcgacgggccagtcaggagttgttcgctacgtttcggttagggtgtactacaaacataaacgtccggcctaggcctcccgaggcctcctctattcctttgattcgtctttacgaacgtacgggcccctgggccgtaccgaggctaggttcaggtggacgtaggtcgggtcgtggggacagtaccttcnctcctcaccatcagccacgcctaagacgtaccgtagaagttattttgacttagttttacttacgtagtacgagtcacggtcgtacgtacccgttacggtttcgggacggtacggtcgtacccgtacggtttccgggacgggtaacgggaactaaaacggtaggaacgggtaacaaacggtacgtaggtcgacgtacgaaccgtactacgttaccgtacgttcccttacgtaccgtttcccg

SEQ ID NO: 305159 - DNA, 537 bp, Homo sapiens
  misc_feature: GZ8MTXP02G2AZM.10.71.G05.1.454.CMB.2.raw
  modified_base (295)..(295): a, c, t, g, unknown or other
  misc_feature (295)..(295): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctgagactctcctgtctgcgtctggattcattctttagaatctggcatgtcctgggtccnctaggttccaggccagggctggatggggtgcagtatatacatatgatgacaagtaaaatgtactagtggagtacctccttagaagggccgtattccaccatctcccagacgacaaattccaaagaactatggtagtaactctagactaaagtcgaaccagcctagacgacgcgaggacgacgggttnttactacgnggtacgganaaacttcgaagtcggactactactacgtgtattacgg

SEQ ID NO: 305160 - DNA, 575 bp, Homo sapiens
  misc_feature: GZ8MTXP02HN0W0.10.71.G05.1.454.CMB.2.raw
  modified_base (505)..(505): a, c, t, g, unknown or other
  misc_feature (505)..(505): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggcgtgggggtccctgagctctcctgttctgcgtctggattcatctttagtaaatctggctatcgtccgtgggtccgcctaggttcccagggtcccgacggggcctaggggaactggggtggcccaagatataacatattgattgaaacagtaaaaactataacgtatacggaagtacttcccgttaacgaaacggggtcctaattcaaaccctatccctacgagaacgaacaaacttacgaaacgtaacagtagggtatatcctaggactaaangacaacgcctagacgacgcgaaggacgtaggttacttatacgtgtaggaactaactcgtagtacgactac

SEQ ID NO: 305161 - DNA, 557 bp, Homo sapiens
  misc_feature: GZ8MTXP02ILOKX.10.71.G05.1.454.CMB.2.raw
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtccctgagactctcctgttctgcgtctggtattcattctttaagtaaatctggcattgtccgtgggtcccnctaggttccaggccaacgggctgggaatggggtgccagatagtaacaattatgatgaacaaagtaaaatatactatggatactctagaaggcccattacacatcaccgaganaacaaattccaaaagtaanagtggtatatcctagaacaaatacgacacgaccgtcgagacgacgacggacgtacggttacgtttaagttagttaaggtaggtaaggtaaacgtacgtacgtagtacgtaacg

SEQ ID NO: 305162 - DNA, 621 bp, Homo sapiens
  misc_feature: GZ8MTXP02H3WAM.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcacatggagttgggctgagctgggttttcctcgttgtctcttttaagagatgtccagtgtcagatgcagatgggtggagtcggtgggggaggcggtcgggtccgggccggtgggggtccctggagtctcgtcctgttctgcgtctggtattctattacttaagtaaatcgtggctagtcgtccgtcggtcccgccgtacggttccgacggtcccgacggggtcgtagggaaggtggggtcggcgaagatataacaatatgatagacgtaaagtaaaatatagtagtcggactacctacgtacgaacgggtctacgtacactactccgacaagaacgactaaacctacgaaagtaactagtgtatactgtagactaatacgactacgactaggaacgtacggaccggtaaggaacgttacggggttaagtttacgttaacgtagggtaggtaacgtaaaaccgtcgttacggtacgacgtacgttacgtacgg

SEQ ID NO: 305163 - DNA, 626 bp, Homo sapiens
  misc_feature: GZ8MTXP02HT0VP.10.71.G05.1.454.CMB.2.raw
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcggtggtccggccgtgggggtccctgagctctcctgttctgcgtctggattcattctttagtaatctggcattcgtccgtgggtcccgccgtacggttcccacgggcccgacgggcgtggaagtggggtgccgagatatactaatatgatanaacgtaaagtaaaaattataacgtagtagggagtaaccttaccgttacgaaacggggcctaactttaccaaccctattaccctaccaagaagaaacctaattaacccaaaagtaaccagttggtatatctaagactaaaagtcgaacacgcctaggaacgacggacccgaagggtaacgtaccggggtttagtttaacgttacggtaaggtacgggaaagtaacgttaccggtaggtaccgtaccaaccg

SEQ ID NO: 305164 - DNA, 649 bp, Homo sapiens
  misc_feature: GZ8MTXP02GZ6VK.10.71.G05.1.454.CMB.2.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtccctgagctctctgtcngctntgntcattcttagtaatgtgctatcgtccgtggtcccgcgtacggttccagggccgacgggtcgtaggagtggggtggaccagatatacaatatgatagaaactaaagttaaaattataacgtagtagggtaacgtaccttacccgttacgaacggggtaccctactttaccaacctattaccctaccgaagtaacgtaaacctaaacttaacccgaaaaggtaaactagttagggtattaacgttcgaagtaactaaaagttccgaaaccgtagacccgtaggaacggaccggaccgggaaacgggtaaccgttacggggtttatttaacgttacggtaagggtaaggtaaacgtaaacgtaccggtaaggtcggtactaaccg

SEQ ID NO: 305165 - DNA, 857 bp, Homo sapiens
  misc_feature: GZ8MTXP02HB5DA.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggtttttcctcgtttgcttacttttaagagatgtccagtgtcagatgcagatgggtggagtcggtgggggaggtcggtgggtcccgggtccggtcggggggtccctggacgtccttctccgtgttctgcgttcgtggtatttctaattacttaagtaatcgtaggctagtcgtccgtcgggtcccgccgtacggttccgacgggcccgacgggtcgtagggtaacgtggggtacgaccgtagtaataagtaaccaaagttattagagtaaggtaaactaaaagttaaaaactaagttaacgtaaagtacgggtaaacttaacccgttacccgtttaaacggaaaccggggtaccccgttaaactttacccgtaaacccctaactttaccccgtaaaccgtaaacggaaccttaaaaacccgttaaacctttaaacccccgaaaaaggttaaaccccgtaaggtttaacggggttaagtttaactaccgtttaacgaaaaccgtaaaacgttacccggtaaacccgtaaacgggaccccgttaaacggggaaacccggtaaccggggaaaccggggttaaaaccggggtaaacccgtttaaacgggggttttaaccgtttttaaggtttaaccggtaagggggttaaccggggtaaagttaaaaaccccgtttggtaacgggttacggtaacgtttaaccgg

SEQ ID NO: 305166 - DNA, 548 bp, Homo sapiens
  misc_feature: GZ8MTXP02HKT9X.10.71.G05.1.454.CMB.2.raw
  modified_base (305)..(305): a, c, t, g, unknown or other
  misc_feature (305)..(305): n is a, c, g, or t
  modified_base (449)..(449): a, c, t, g, unknown or other
  misc_feature (449)..(449): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagctctcctgttctgcgtctggattcatctttagtaaatctggcatgtcctgggtccncaggttccaggccacgggctggatggggtgccagatatacaatatgatgacaagtaaaatatactatggagtactccttagaaggggtccaatttcaaccatcctacccagaacgacaaattacccaaaggtaaccatagggtntatcgtagacaaaatgaccagccctagacgagccgaagggacaccggggttagtttaactagtggtagggaacgtaaaactccttaggcggtactaacg

SEQ ID NO: 305167 - DNA, 571 bp, Homo sapiens
  misc_feature: GZ8MTXP02JSTKZ.10.71.G05.1.454.CMB.2.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggacttaccatggagtttgggctgagcgtgggttttcctcgttgctctttaagagatgtccagtgtcagatgcagatggtggagtcgtgggggaggcggtggtccggcgtgggggtccctgagactctcctgttctgcgtctggattcatctttagtaaatctggcatgtcctgggtccnccaggttccaggcccacgggctggaagtgggtgcagatatacatatgatgacaagtaaatatactagtgganactcttacgaagggccattccacatctaccagagactaaattaccaaagaactagtggtagtaactcgtagacctaaaatcgaaccagaccctaggacggacgacccggaagggtaccgtaacgggggttnttttaacgtacgttggtaacgggtaaagtaaaacgtcccgtaggtcggtactacgttacccg

SEQ ID NO: 305168 - DNA, 798 bp, Homo sapiens
  misc_feature: GZ8MTXP02HBQVI.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagtctgggttttcctcgttgcttcttttaagagatgtccagtgtcagatgcagatggtggagtcgtgggggagcggtcgggtccggcggtcgggggtccctggacgtactcgttccgttgttctggtcgtcgtggtacttcgtatttacttaaagtaaatcgtaggactagttcgtcccgttcggggttccccgaccggtacggttcccgaacgggtcccggaaccggggtcgtaggggaaaggtttggggacggtacgaaagtaataataaacgaaagttagtagtaagtagaaaacttaaaggtaaaaaacttgttaaacttagtacgggaaactacccgtttaccgtaaacggtaaacggggtacctacctttaaccaacccgtaactacccttaacccgaagtaaaccgaaaccttaaacttaaacccgaaaacgtaaacgtaggttaggttaactaaacgtttacgaacgtaaacgtaaaagtcccggaaacccgtacggtaccccgtaggaacccggtaaccgggaaaccggtaaaacgggttaacggttaaccggggttttagttttaaacgttaccggtaggggttaaccggaagttaacgtaccggtaaggacgtactacgtaaccgtcggttagttaacgttccggg

SEQ ID NO: 305169 - DNA, 544 bp, Homo sapiens
  misc_feature: GZ8MTXP02GM05F.10.71.G05.1.454.CMB.2.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtccgtgggtcccgccaggttccaggccacgggctggatgggtgcagatanacatatgatgacaagtaaaatntacatgganactcctcgaagggcctatcacatcctcaganacaataccaaagaacagtgtagtatcgtanacaaatcgaaccagccgtagacgacggaccggaggaccgtacggggttactttaacgtacgtaggtagggtaagaaacgttccgtaaggtggactacgtacctaaccg

SEQ ID NO: 305170 - DNA, 669 bp, Homo sapiens
  misc_feature: GZ8MTXP02IHYPW.10.71.G05.1.454.CMB.2.raw
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (469)..(469): a, c, t, g, unknown or other
  misc_feature (469)..(469): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagttgttcgctacgttcggttaggggtgtatacaaacataaanccggcaggctccaggctcctnatctttnatgtctttnaaccgcggcccctggcctcccgaggctaggttcaggtcggnaggtggtagnggacagtacctcactccgtaccacctagcctaggaccagtacccgtagtacgtacccgtagtaagttacgttttgacttaagttttacttacgtagttcgaagtcncggtaccgtgtaccccgttacggtttaccggggcgggttacgggtacgttcccgttaccggtttccggggaacgggtacggggaaaaccctaaaaaggttcgggaaaggttaaacccgaaaaacggtacgtacgggtaacggtccgtacggtaaccctaacggttcttacggtcgtttccgttacgtaaccctttccccg

SEQ ID NO: 305171 - DNA, 647 bp, Homo sapiens
  misc_feature: GZ8MTXP02GOA6G.10.71.G05.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaancgccacctctcctgcgaggccagtcagagtgttcgctacgttggttaggggtgtatcaacataaatccggccaggcctcccgaggctcctnatctttgatgctttacaacgtacggcccctggccgtcccgaggccgtagggttcgaggtggcgtaggggttgggtccgtaggggacctaggtaccttcgacctcctacaacccataccgagaccacgtaccgtagacgtcctaggtaaagttagttttcgacttaagttttattacgtgtacgtacggctacggtacgttcgacccttacgggttttccggggacggtacggtcgtacccgttacggtttccgggacgggtaaacgggaacctaaaagtacgggaaacggtacaaaacggtacgtcgtacggtctaggccgaacttacgtcttcgtacttaccctatttccccg

SEQ ID NO: 305172 - DNA, 653 bp, Homo sapiens
  misc_feature: GZ8MTXP02F53IG.10.71.G05.1.454.CMB.2.raw
  modified_base (484)..(484): a, c, t, g, unknown or other
  misc_feature (484)..(484): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagagtgggtggagtcggtgggggaggtcggtcgggtcccggccggtcggggggtccctggacgtactcctcgtgttctgcgtctggattctattctttaagtaactcgtggactagtcgtccggtcggtcccgccgtacggttccacgggcccgacggggtctagggtaacggtggggtggacgtagtaactagtaactaatagtcgaattacgactaaagttaaaatagttaacgtagtaggactaccttacgttacgaacgggtcctaattacccacgtacncccgtacgaaggacaaactaagtaccaaacgatagtgtatactgtacgaactaagtcgaccagtcgtaggacgacgacggaggtacgttaacgggttagtttaactagggtacggtaaggggtaaaacttaacgttacggttacggaggtacctactaccggttaacgg

SEQ ID NO: 305173 - DNA, 640 bp, Homo sapiens
  misc_feature: GZ8MTXP02I2N1J.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagagactcaccatggagtttgggctgagcgttgggttttcctcgttgcttcttttaagagtatcgtccagtgtcagatgcagtagtgggtggagtcggtgggggaggcggtgggtccggccggtgggggtccctgacgactctcctgttctgcgtcgtggtattctattctttaagtaaactcgtggtctagtcgtccgtcgggtcccgcgtacggtccgacggccgacggtcgtaggagtggggtagaccgaagtataactaactaatagtagatagaactaaagttaaaatataacgtagtaggaactacttacgttacgaacgggtctacttaccacctactcgacagactaactaacttaccgaagtaactagtggtatacgtatacgaataaacgtcgaaacgcgtacctaaggacggacgaccgggtaacggtaaacgttacggggtttactttagttaccggtaagggtaacggtaaacgttaaacgtcgtaacggtacggacttaacg

SEQ ID NO: 305174 - DNA, 632 bp, Homo sapiens
  misc_feature: GZ8MTXP02I2SS6.10.71.G05.1.454.CMB.2.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (425)..(425): a, c, t, g, unknown or other
  misc_feature (425)..(425): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaancgcctaccctctcctgcagggccagtcagagtgttcnctacgttgtagggtgtatcaactataatccgcagctccagctcnattctttgatgtctttacgaacgtacggcccctggcccgttacccgaggtctacggttcagtggcagggttggccgtggactagtacttcacgtctacacctagtccgagaccagccctaagactcctaaggtaaagtttntttacgacttaagtttactactgtacacgtacgtacggtcgtacgtacccgttacggttcggcggtacggtcgtaccgttacggttacggggaacggtaaacggtaaaacctaaaaggtacgggtaactaaaccgtaaaacggtacgtacggtacggtacctacgaaccgtacgttacgttcttacgtaccttactaccgttacccg

SEQ ID NO: 305175 - DNA, 626 bp, Homo sapiens
  misc_feature: GZ8MTXP02HM3ZB.10.71.G05.1.454.CMB.2.raw
  modified_base (216)..(216): a, c, t, g, unknown or other
  misc_feature (216)..(216): n is a, c, g, or t
  modified_base (394)..(394): a, c, t, g, unknown or other
  misc_feature (394)..(394): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcacatggagtttgggctgagcttgggttttcctcgttgctcttttaagagtatgtccagtgtcagatgcagatgggtggagtcgngggggagcggtgggtccggccggtgggggtccctggacgtctctcctgttctgcgtctggtattcattactttagtaaactcgtaggctagtcgtccgtcgggtcccgccgtacgggttccacgggccgacggggctagggaagtggggtggacagtatagtaactatattagagtanaaactaaagtaaaatacttacgtaagtcgggaaacttaccgttccttaacggaacggggcccttaattaccaaccctattccctaccaagtaacgtaaactaaaccttaccgaaaagtacttagtaggttagtactacgtagaacaaagtcgaaccngtaccgngagacgtccggaggtacgtacggttgtttacagttggtacgggaataacgtcgtagtcggtactacgg

SEQ ID NO: 305176 - DNA, 637 bp, Homo sapiens
  misc_feature: GZ8MTXP02IDY7Y.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgtttgcttcttttaagagatgtccagtgtcagatgcagatgggtggagtcgtgggggaggtcggtggtccggccgtgggggtccctgacgctctctgttctgcgtctggtattctattacttaagtaaatcgtggctagtcgtccgtcggtccccgcgtacggttcccgacgggcccgtacgggtcgtaggaaggtggggtacgccgtaagtaattaactaacgtaaattagtagtagtacgtaaactaaagttaaaaattataacgtagtacgaacgtacctccgttaacgacggtaccacgttaccacctactcctaccgagtacgaaactaacgttaaccaaagtactaagtggtatcgtacgtagacaaagtcgaacgtacgacctaggacggacgacgtaacggacgttacgggttacgtttagtacgtaaggtacggtaactaacgtcgtacggtcggactaacg

SEQ ID NO: 305177 - DNA, 665 bp, Homo sapiens
  misc_feature: GZ8MTXP02GZJ4B.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcggtggtccggcgtgggggtccctgagctctctgttctgcgtctggattcattctttagtaatcgtggctattcgtccgtcgggtcccgccgtacggttcccagggccgacggggtctgggaagtggggtgccagataataacaatatagatagaaactaaagttaaaaactataacgtagtagggaaacgtacccttacccgttacgaaacggggtaccctaactttacccgaaccctattaccctaccgaaagaacgtaaactaaacttaacccgaaaagtaaaccgtagttagggtagttactacgtacgaactaaaagtccgaacctagacccgtaggaacggacggacccggaaggtaaccggtacggggtttatttaacgttaacgtaaggggtaacgggtaaacgtaaaacgtccgtaaggtacggactaacg

SEQ ID NO: 305178 - DNA, 570 bp, Homo sapiens
  misc_feature: GZ8MTXP02FJY5K.10.71.G05.1.454.CMB.2.raw
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcggtggtccggccgtggggggtccctgagactctctgttctgcgtctggattcatctttagtaatctggcatgtcctgggtccgcaggttccaggccgacgggctgggaagtggggtggcagacgtatacaatatgatgacaagaaaatatactatggagactccttacgaaacggtccgattaccaactactcctaccaagacgaacaattacccaaagaaacagtggtatactatagacaaagtacgaacagaccgtagaggacggacggacggacgtacgggttagtttaacgttacgtggttagggaaagtaaacgtccgttaaggtggactaacgtccttaacgg

SEQ ID NO: 305179 - DNA, 751 bp, Homo sapiens
  misc_feature: GZ8MTXP02FUPIP.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccgggccgtggggggtccctggagctctcctgttctgcgtctggattcatctttagtaaatctggcatgtcctgggtcccgccgaggttcccagggcccacggggtctagggaagtggggtggacccaggtactagtacaatattaggatggaaactaaagttaaaaactattaactagtagggaatacctacctttaccggaaacgggggtcccgtaaactttccaaccctaattccctacccgaaagaacggtaaaaccaaaactttaacccccgaaaaggtaaaaccctaagtttacgggttaacgttaacgttaccgttacggaactaaaacgttacgaaacccccgaacggaccccgttaagggaaacggtaaaccgggtaccccgggaaacgggggttaaaaccgtaacccggggggttttaagttttaaacgtttaaaccgttgggggttaagggggtaaaacgtaaaaacgtttacccccggtttaaagggttaccgggtaccttaaaacccgg

SEQ ID NO: 305180 - DNA, 530 bp, Homo sapiens
  misc_feature: GZ8MTXP02GOJ7B.10.71.G05.1.454.CMB.2.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
  modified_base (432)..(432): a, c, t, g, unknown or other
  misc_feature (432)..(432): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgagggaaangccacctntcctgcagggccagtcagagtgttcgctacttcggttagggtgtatcaacataaanccggcagctccagctcctcatctttgatgctttcaacacggccctggctcccgaggcagggttcaggtggctagtgggtctggggacaggacttcactctacactatcaagcagcctaagacgcctagaacgtaattttgactagtttaattactgtcagcagcgtnccgtacgtttcggccggtagtcgctacgttcggacggaggaacaaaagtgaaggtacaaaacgaactgacgtcagctacatcgtctctacacttcccg

SEQ ID NO: 305181 - DNA, 740 bp, Homo sapiens
  misc_feature: GZ8MTXP02H0CIT.10.71.G05.1.454.CMB.2.raw
  modified_base (610)..(610): a, c, t, g, unknown or other
  misc_feature (610)..(610): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggtagtttgggctgagtcgttgggtttttcctcgttgtcttacttttaagagtatcgtccagtgtcagatgcagagtggtggagtcggtgggggagcggtcgggtccgggccggtcgggggtccctggacgtacttccttccgtgttctgtcgtcgtggtacttctacttacgtttaagtaaacgtcgtggcctagtcgtccgtcggggtccctccggtacggttcccgacggcccggtacggggtcgttagggtaaggtcggggtacgtaccgtaaggtagttaaactaaacctaaaagttagtagtaaagtaaggaaaacgttaaaagttaaacttaataaacgttagtacgggtaaccttacccgtaccgtttaacggaacggggtaccctagttacccaacctactaccgtacccgaaagtaacgaaacctaaacttaccgaaaagtaaacgtagtggtaagttactacggtanaaaccgtaatacgaaccgtagaccgtaagacggacgaaccgggtaacggtaccggttagggttactttaaggacgttagggacgtaagtacgtaacgtaggtcgacctagtacccgtaggtttagttacg

SEQ ID NO: 305182 - DNA, 554 bp, Homo sapiens
  misc_feature: GZ8MTXP02FH79D.10.71.G05.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (539)..(539): a, c, t, g, unknown or other
  misc_feature (539)..(539): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggttgagctgggttttcctcgttgctcttttaagagatgtccagtgtcagatgcagatggtggagtcgtgggggagcgtggtccggccgtgggggtccctgagctctcctgttcngcgtcnggtattcatctttaagtaatcgtggcatgtccgtaggggtccnccgtaggttccgacggcccgacgggctgggaacgtggggtcggcagatanacaatatgatnaacaaagtaaactntactagtaggatacctctacgaagggcctataccaccatcctcagtanacacttaccgaaanacagtggtntanctgacaaacgtcgaacccagtccagacggacgccggaacgaccgtacgggttactttatacgtggtaaggaatactacgngtacgactacgtccg

SEQ ID NO: 305183 - DNA, 682 bp, Homo sapiens
  misc_feature: GZ8MTXP02GNS65.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagtcttgggttttcctcgttgcttcttttaagagtatgtccagtgtcagatgcagagtgggtggagtcgtgggggaggcggtcgggtccggcgtgggggtccctggagctctctgttctgcgtctggtattcattcgtttaagtaatcgtggactatcggtccgtcgggtcccgccgtacggttcccgagggcccgtacggtcgtagggtaacgtggggtaggacaggtaatacgtaacaaagttagtagataggaaactaaagttaaaaatgttaaccgtaagttacgggaacgtaccgttacccgtttacgggaaaacggtccccgtatttacccgacctaacttaccgtacccgtaagaacgaactaaacgttaacccaaaggaaactggttaggtacgtattacgacgtaacaaagtaccgaccgagaccgagacgacgaccgggaagtacggtacgggttagtttaccgtagtcgggtaagggtaactaagtccgttaaggacgtactacgtacgtccgttaaggttacgtttcgg

SEQ ID NO: 305184 - DNA, 715 bp, Homo sapiens
  misc_feature: GZ8MTXP02JH4FH.10.71.G05.1.454.CMB.2.raw
  modified_base (390)..(390): a, c, t, g, unknown or other
  misc_feature (390)..(390): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgctcttttaagagtatgtccagtgtcagatgcagatggtggaggtcgtgggggagcggtgggtccggccggtgggggtccctggacgactctcctgttctgcgtctggattcattacttaagtaatcgtggctagttcgtccggtcgggtcccgccgtacgggttccgacgggcccgacggggtctagggaagtggggtcggacagtataataactaatanagtatacgaaataaagttaaaaattacttaaactagttagggaaacgtacctttacccgttacggaaacggggtctaacttaccgaaccctactacctaccgaaggtaacctaaactaaaccgtttaacccgaaaaggttaaacctaaggttacgggtttagtaacttccgtaaggaaacctaaagttaccgaaacccgaggtaaccccgtaggacgggaaccgaccggggaacgggtaaaccgttacggggtttagtttaacgttacggttaagggtaagggtaaaacgttaaacgttaccggtaaaggtccgtacgttaaccg

SEQ ID NO: 305185 - DNA, 709 bp, Homo sapiens
  misc_feature: GZ8MTXP02JEMKS.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagagtggtggagtcggtgggggagcggtgggtccgggccggtcggggggtccctggacgtctcgtcctgttcgtgcgtctggattcattctttaagtaaatcgtggctagtcgtccgtgggtccccgccgtaggttcccgacgggtcccgaacggggtcgtagggaagtcggggtagaccgtaagtataactaacaattagtagactagaaactaaaagtaaaaactattaactaagtaggtaaactacctacccgttaacgaaaacggggtccctaaattacccaacctaacgttcccacccgaaaggtaacaaacctaaaacttaacccgaaaagtaacctaagttagggtattaactccttaaggaacctaaaagttccgaaacctacggaccctagggaacgaacggacccggaaaggtaccggttacggggttagtttaacgttaacggtaaggggtaacggggtaaaactaaaacgttccggtaggtaccggacttaaccg

SEQ ID NO: 305186 - DNA, 838 bp, Homo sapiens
  misc_feature: GZ8MTXP02GYM7H.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttctttttaagagatgtccagtgtcagatgcagatggtggagtcgtgggggaggcggtggtccggccgtgggggtccctgagactctctgttctgcgtctggattcattactttagtaactcgtgctagtcgtccgtggggtcccgccgtacggttcccgacggccggacggggtcgtacggggtaaggtcggggtcggacccgtaaggtattaacgtaactaaattagtaggtacttacggtaaaagtaaaaggttaaaaaactttaagttaaacctttaaaggtacgggggtaaaaccttaccctttacccggtttaaacggaaacgggggtaccccttaaacgtttaccccaaaccccggtaactttacccgtaacccggaaaacgtaaacgttaaaaccctaaaccttttaaaccccgaaaaaggttaaacgaccggtttttagggggtaacttaaaccgtttcaaaccggttaaactaaaaaacggttccccgaaaacccgtacggttacccgggtaagaaaaccggggtccgggaaaaccccggggtaaggggtaaaacccggttaccgggggtttttaatttaaccgggtttaacgtaagggggtaaacggggtaaaactttaaaaccggtcggtttacggaacgggttacttaaacccgg

SEQ ID NO: 305187 - DNA, 696 bp, Homo sapiens
  misc_feature: GZ8MTXP02IYGN1.10.71.G05.1.454.CMB.2.raw
  modified_base (401)..(401): a, c, t, g, unknown or other
  misc_feature (401)..(401): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggccgtgggggtccctgagctctcctgttctgcgtctggattcattctttaagtaaactcgtggctagttcgtccgtcggggtccccgccgtacgggttccccgaacgggcccgaacggggtccgtaggggaagttgggggtacggacccgagtagtaataacaaattagngtagtacgaaactaaagttaaaaattataactaagtcgggaaacgtaccttacccgttaacggaaacgggggcccttaaacttcaacccctacttccgtaacccaagaacgaaaccgttaaacttaccgaaaacgaaaccttaggttagggttagttaacgtcgtaagaacgtaaaacgttcgaaacccgagtcccgtagaggaaccggaccggaacggtaacggtacgggtttagtttaacgttacggtaaggtaacggggtaacttaaacgtccggttaagtcggtactaacg

SEQ ID NO: 305188 - DNA, 622 bp, Homo sapiens
  misc_feature: GZ8MTXP02I70DA.10.71.G05.1.454.CMB.2.raw
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaagacgcccaccctctcctgcagggccagtcagagtgttcgctacgtttcggttaggggtggtatcaaacataaatccggccaggctcccaggctcctcatctttgatgtctttcaacgcggtcccctggcctcccgaggccaggttcaggtggcaggtgggtctgggacagtaccttcaccgtctccacatccagcacgcctagagcctagaagtattttagctagttttactactgttcagtcagtcgtacgtcctacggtttcggacggtacggttcgccgtaacgtttccggggacgggaacggggtaaaccctaaaaggtacggtaaacggttaacgaaaaacggtaaacgttcgggtacgaccgttacgaaccgtaccctaagttccctggtttaccttacgtaacctttccccg

SEQ ID NO: 305189 - DNA, 654 bp, Homo sapiens
  misc_feature: GZ8MTXP02I55AC.10.71.G05.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtctccgaggggaaancgccaccctctcctgcgagggccagtcagtgtgttcgctacgttcggtagggtgtatcaacataactccggcaggcctccgagcctctntacgttctttgactcgtactttacgacgcggtcccctggccctcccgaggctaggtcaggtggacgtaggtcgggtcgagggactagtaccttcncgttcacaccgatccgagtaccagtaccctagacgtccgtaggtaactttgtttacggacctttaagttttactacgtgtacacggtaccgtggtccgttcgacccgttagggtttaccggggcgttacgggtcgtacccgttaggttccggggaacgggtaaacggaaaccgtaaagtacgggaaacgtacgtaaaacggcgttaggtacggtacctacgtaacctaacgtactttccgtcgtttaccttacctacgtttccccg

SEQ ID NO: 305190 - DNA, 634 bp, Homo sapiens
  misc_feature: GZ8MTXP02IZNWQ.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtgggtccggccgtgggggtccctgagtacctctccgtgttctgcgtctggattcattcttaagtaatcgtggtcagttcgtccgtcggggtcccgccgtaggttcccgacgggcccgacggggtctagggtacgtggggtcgaccgagtagtataaccgtaattatagatagaaactaaagtaaaacttataactaagtcgggaaactaaccgttccgttaacgaacggggtccctaattaccaccgtattcccgtacaagacgtaactaaacttaccaaagtaactagtggttatactcgtagactaaagtcgaaccagtacctaggacgacggcccgaaaggtaccgtacgggttatttacgtacggttaagggacggtaaaagtaacgtccgtaggtacgactaacg

SEQ ID NO: 305191 - DNA, 728 bp, Homo sapiens
  misc_feature: GZ8MTXP02FJB4L.10.71.G05.1.454.CMB.2.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaanagccaccctctcctgcgagggccagtcagagttgttcgctacttcggttagggtgtancaacataaacgtccggcaggcctcccgaggcctcctctattctttgatgtctttacaacgcggcccctggccgtcccaggcgtaggttcgaggtcggcgtagggtcggggtcgtggggactacggtaccttcgacttcctacctaccactcgacgtctaacggtacccgtaaggaccggtacccgttaaggtaaaggtttacgtttttcggaccgtttaaagtttttaactttaccgttcggttacaaacggtccgtaaagggtcccggttacgtaccccgttacgggttttacggggaccggggttagggtaccggtcccgttaacgggttccggggtaacggggaaacgggtaaaacctaaaaagggtacggaacgggtaaaccgtaaaacggtaaccgttgggtacgccgttacgaactaacccgtacgttccgttacgttccttacggtacctttccccgg

SEQ ID NO: 305192 - DNA, 722 bp, Homo sapiens
  misc_feature: GZ8MTXP02HLCMD.10.71.G05.1.454.CMB.2.raw
  modified_base (297)..(297): a, c, t, g, unknown or other
  misc_feature (297)..(297): n is a, c, g, or t
  modified_base (470)..(470): a, c, t, g, unknown or other
  misc_feature (470)..(470): n is a, c, g, or t
  modified_base (701)..(701): a, c, t, g, unknown or other
  misc_feature (701)..(701): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgttctttgtcctaccgaggggaaagacgcccaccctctcctgcgagggccagtcaggtagtgttcgctacgttcggttagggtgtatcaacataatccggcaggctccagcctccnattctttgatgtctttacacgacggtcccctgggcctacccgaggcctaggttcgaggtcggacgtacgggttcggggtctaggggaacctaggtaaccctttcaccgttcctaacccaccgtagttccgaacgcctaacggacccgtagaccggtcctaaggtaaacgtttntttttacggactttaggttttaattacgtcgtacaagggtccaaggttccggttacgtaccccgttacggggtttccggaccggggttaggttcccgtaccggttaacgggtttcccccgggggaaagggttacgggaaaacccgtaaaaaggttacgggtaaacgggtaaaccgtaaacggtaacgttacgggtaccggtcttaacggaactaccgtagttacccggttnttaccttactaccgtttcccg

SEQ ID NO: 305193 - DNA, 582 bp, Homo sapiens
  misc_feature: GZ8MTXP02HBDRX.10.71.G05.1.454.CMB.2.raw
  modified_base (250)..(250): a, c, t, g, unknown or other
  misc_feature (250)..(250): n is a, c, g, or t
  modified_base (388)..(388): a, c, t, g, unknown or other
  misc_feature (388)..(388): n is a, c, g, or t
  modified_base (504)..(504): a, c, t, g, unknown or other
  misc_feature (504)..(504): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcggtggtccggcgtgggggtccctgagctctctgtcngcgtctggattcattctttaagtaaatctggctatgtccgtgggtacccgccgtaggttcccgacggcccgacgggctaggaagtgggtgcagtatagtacaatatgatagaactaaagtaaaatataactagtgganaccttctacgaacgggcctattccacatccacgagacgaacaattaccaaagactagtgtatactctagactaaagcgtaccagctagagtaccgcgaacggtacgtacgggtttntttaacgtacgtagggtaaggaaacgtaacttaccgtaaggtcggaacctatccgtaaccgttaggtactttaccggg

SEQ ID NO: 305194 - DNA, 630 bp, Homo sapiens
  misc_feature: GZ8MTXP02GDWT6.10.71.G05.1.454.CMB.2.raw
  modified_base (365)..(365): a, c, t, g, unknown or other
  misc_feature (365)..(365): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtgggtccggccgtgggggtccctgagctctcctgttctgcgtctggattcattctttagtaatctggctatcgtccgtgggtcccgccgtacggttcccgacgggccgacgggctagggagtggggtgcagatatacaatntgatgaacaaagtaaaatataactagtggactactctacgaagggcctattccgactatctaccaagacgaactaaacttaccaaagtaactagttgggtacttactacgttagacgtaaaacttccgaaacccgtgacccgttaggaacggaaccgggaccgggtaaacgggtaaccggttaaccgggggtttagttttaacgtttaacggtaaggtttacggggaaacgtaaaacgttacccggtaggttacggactttaacg

SEQ ID NO: 305195 - DNA, 628 bp, Homo sapiens
  misc_feature: GZ8MTXP02FH6W7.10.71.G05.1.454.CMB.2.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtcttttgctccgaggggaaanagccaccctctcctgcagggccagtcagagtgttcgctacttcggttaggggtgtatcaacataaatccggcaggctcccaggctcctcatctttgatgtctttacaacgacgggtccccctgggccgtcccgaggcctaggttccaggtcggcaggtgggtctggggacagtaccttcactctcaccatcagcagcctagagcctagaagtattttgactagtttattactgtcagtcagcgtgcctacgtttcggacggtaggtcgaccgtacgtttccgggacggggtaacggggaaacccgtaaaaagttacggaaacgggttaaaccgaaaacggtaaaccgttagggttacggccgttacggaaccgtaaaccccgtaattacccgtttacggtttacctttacctacgttttcccccg

SEQ ID NO: 305196 - DNA, 546 bp, Homo sapiens
  misc_feature: GZ8MTXP02FH6T3.10.71.G05.1.454.CMB.2.raw
  modified_base (212)..(212): a, c, t, g, unknown or other
  misc_feature (212)..(212): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctntcctgcagggccagtcagagtgttcgcacttcgttaggggtggtatcaacataaatccggcaggctcccaggctcctcatctttgatgctttcaacagggcccctggcgtcccaggcaggttcagtggcagtgggtctggggacagacttcnctctcaccatcagcagcctagagcctgaagtattttgctagttttaattactgttcagcagcgtgcctactttcgggcggaggtcgtccgtacgtttccgggcggggaacgggaaaccgaaaaagtaaggaaggtacgaaaacgaaactgtacggctgcacactactgttctactagttccc

SEQ ID NO: 305197 - DNA, 661 bp, Homo sapiens
  misc_feature: GZ8MTXP02IWN7D.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtgggggtccctgagctctcctgttctgcgtctggacttcattctttaagtaaatctggctattcgtccgtgggtcccgaccgtaggttcccagggcccgacggggtctagggaagtggggtgaccagatataactaatatagatagaactaaagttaaaatataactaagtaggaactaccttaccttacgaaacggggcctaattaccaaccctattcccgtaccagaacgtaaactaaacttaccgaaaagtaactacgttagggttataacttctacgaactaaaacgtcgaacctacgaccgtaggacggtaacggacccggtaacgggtaaccggttaccgggggtttattttaacgttaacggttaagggtacggggtaaacgttaaaacggtccgtttaaggtacggtaccttaaccg

SEQ ID NO: 305198 - DNA, 735 bp, Homo sapiens
  misc_feature: GZ8MTXP02JTGQ9.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgtcttcttttaagagatgtccagtgtcagatgcagagtggtggaggtcgtgggggaggcggtggtccggcggtgggggtcctgagtctctctgttctgcgtctggtattctattactttaagtaatcgtggtctagttcggttcccgtcggggtcccgaccgtacgggttcccgacgggtcccgaccggggtcgtaggggaagtgggggtcggaccgtagaattaataactaatacgtagtatagaaactaaagttaaaaatattaaactagtagggaactaccgttacccgttaacggaacggggtaccctaagttaccaacccgttataccctacccgaagaacgtaaacctaaacttaacccgaaaagtaaacctagttagggttagtacttaccgtacgtaaacctaaaacgttccgaaaccctacggtacccttaagggaccggaaaccgggacccggggtaaacggtaccggttaacggggtttacggttttaacgttaaaccggtggggtaacggggtaaaacgtaaacgttaccggtaggggtacgtaccgtaaccg

SEQ ID NO: 305199 - DNA, 778 bp, Homo sapiens
  misc_feature: GZ8MTXP02I0E9G.10.71.G05.1.454.CMB.2.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagcccccagctcagcttctcttcctcctgctactctggctcccagacaccaccggagaaattgtgttgacacagtctccagccacgctgttctttgtctccgaggggaanacgccaccctctcctgcagggccagtcagagttgtcgctacgtttcggttagggtgtactcaacataaacgtccggaccaggcctcccgaggccttcctctattctttgattcgtctttacgaacgacgggtcccctggcccgtcccgaggcgtacggtttacaggtcggcgtacggggttcgggtccgtaggggaactacggtacccttcgaccttccgtaaccaccgtaactccgaacgcctaacgtcccgttaaggacgtacccgttaaggtaaacgtttgtttttacgaccgtttaatttttacgttaacgttcgacgttaacggccgtaaggtccgttacgacccgtttaccgggtttaccgggacgggtacggttccgaccccgttacgggtttaccggggaccggggtaaaaccggtaaaaccgtaaaaggttaccgggtaacggttaaccgaaaaaaccgggttaacccgttcggggttaaaccggggtacttaaccggggaaccccgtaaccttaacgtttcccgtacggttttaccctttaaccgttaccgttttaacccccg

SEQ ID NO: 305200 - DNA, 680 bp, Homo sapiens
  misc_feature: GZ8MTXP02JYNTY.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcggtgggtccggcggtcgggggtccctggacgtctctccgtgttctgcgtctggtattctattactttaagtaatcgtggctatcgtccgtcgggtcccgccgtagggttccccagggcccgacggggccgtagggaacgtggggtggacctaggataacgtaactaatatgatgaaactaaagtaaaatataacgttagtacggaacgtacccttaccgtacggtaaacgggtcccgtaacgtttacccaacccgtaacttaccttaacccgaaaggaacctaaacctaaactttaacccgaaagtaaacctaggttacgggttacgttaacttccgtagaaccgtaaagttccgaaacccgacgtaccgtaggaacggaccgaccggaaagggtaccgtacggggttactttaacgtacgtgggtacggaagtaactcgtacggtcgactaacg

SEQ ID NO: 305201 - DNA, 671 bp, Homo sapiens
  misc_feature: GZ8MTXP02HNUQG.10.71.G05.1.454.CMB.2.raw
  modified_base (201)..(201): a, c, t, g, unknown or other
  misc_feature (201)..(201): n is a, c, g, or t
  modified_base (389)..(389): a, c, t, g, unknown or other
  misc_feature (389)..(389): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaangccacctctcctgcagggccagtcagtagtgttcgctacgttcggttagggtgtatcaacataaacgtccggacaggcctcccgaggtcctcctcattctttgactgtcctttacgaacgcgggtcccctgggccgtcccgaggctaggttcaggtggctaggtcgggtctggggactacgtacttcnctctacacctatccagaccacgcccttaaggcgtccgtaggtaaacgttgttttaggacctttaaggttttaactttacgtacgttacgaaggtccgtaaggtccggttacgacccgttacgggtttcggggacgggtacggttcgacccttacgggtttcggggaacggggtaacggtaaacccgtaaaagtacgggtaacggtaaaccgtaaaacggtaacgttcggtacggtctacggaacctacgtacttcgtaacgttccttaccgtctttaccccg

SEQ ID NO: 305202 - DNA, 670 bp, Homo sapiens
  misc_feature: GZ8MTXP02JCS0B.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatgggtggagtcggtgggggagtcggtggtccggcgtgggggtccctggacgactcgtcctgttctgcgtctggtattcgattctttaagtaaatcgtggcagttgtcccgtgggtcccgccgtaggttcccacgggtccacggggtcgtagggtacgtggggtaggacccgtaagattaacaagtaaatatagtacgtagaaactaaagttaaaaatataaacgttataggaacgtaccttacgttacgaaggggtccctaacgttaccacctacttaccacgaagaagtaaacctaaattaccaaaacgtaaaccgtaagttcgggtaattacgtacgtagaacctaaagtcgaaaccagtacccgtaagacggacgacccgggtaaaggtaacgttaccgggtttagtttaagtacggtaagggtaacggtaaaagtaacgttaccgaggttacggaactacgg

SEQ ID NO: 305203 - DNA, 700 bp, Homo sapiens
  misc_feature: GZ8MTXP02GN899.10.71.G05.1.454.CMB.2.raw
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggccgtgggggtccctggagctctcctgttctgcgtctggtattcattctttaagtaaatcgtggctagtcgtccgtcgggtccccgccgtacggttcccacgggcccgacggggtccgtagggaagtggggtggccaggatataacaattagtgatgaactaaagttaaaatataacgtagtagggtagtaccttacccgttacgaaacggggtccctaactttacccgaaccctacgttccctaaccgaggaacgtaaaccttaaacgttacccaaaacggtaaacctagttagggttacgttaacttaccgtacggtaacctaaaaagttccgaaacccgtaagaccccgttaaggaacggaacggaccccggtaaaggtaaccggtacgggtttacgttttaacgttacggttaagggttaacgggaagttaaaacgtcccgtttaaggtacggtactttaaccg

SEQ ID NO: 305204 - DNA, 631 bp, Homo sapiens
  misc_feature: GZ8MTXP02G4VWM.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatcttagtaaatctggcagtcgtccgtgggtcccgccgtaggttcccagggcccgacggggtctaggaagtggggtggcagatatacaatatgatagactaagtaaaatagtaactagtaggaagtaccttaccgttacgaaagggggtccctaatttacccaaaccctatcctaacccgaagaacgaacctaaacttacccgaaaagaacctaagttcgggtagttatccttaggaaccaaaatcgaaaccacgtcccgtaaggaacggacgaccggaagggtaacgtacggggttatttaacgttacgtagggttagggaaactaaacgtccgtaagtcggacagtcctacgtggttattacgg

SEQ ID NO: 305205 - DNA, 593 bp, Homo sapiens
  misc_feature: GZ8MTXP02GB8KA.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggccgtgggggtccctgagactctcctgttctgcgtctggattcatcttagtaatctggcatgtcctgggtcccgccgaggttccaggccgacgggctggagtgggtggcagatatacaatatgatagacaagtaaatatactataggatactacttagaacgggtccagttaccactaactcctaccgagacgactaacttaccaaagaacctagtacggttagttactcgttagaactaaattcgaaccgaggtccctaggaacgaacggcccggaaaggtaccgtaacgggtttgtttaacgttacgtacggtagggaacgtaaacttccgtaagttcggacctagtacccacggttaggtaacgtttgg

SEQ ID NO: 305206 - DNA, 711 bp, Homo sapiens
  misc_feature: GZ8MTXP02IT4XT.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtggtccggcgtgggggtccctgagctctctgtctgcgtctggtattcattctttagtaatcgtggctagtcgtccgtgggtccccgccgtaggttcccgaggccccgacgggtcgtagggaagttggggagcgaagtactaaatacaatagtacgatacgaaactaagttaaaaatcttaaacgtagtacgggaacttaccgttacccgtttaacggaacgggtaccctagttacccaaccctacttcctaacccaaggaacctaaaccgtaaacttaaccccgaaagtaacctaaggttacgggttagtaaacgttccgtagtaactaaaagttccgaaaccgtaccgtacgtacggaacggaacggacccgggtaaacggtaccggtacggggttttatttaacggttacgtagggttaacgggtaacgtaacggttacccgttaaggacggtacctaacgtccgtaaaccggtttggttaacgtttccgggg

SEQ ID NO: 305207 - DNA, 651 bp, Homo sapiens
  misc_feature: GZ8MTXP02FI2ZG.10.71.G05.1.454.CMB.2.raw
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtgggggtccctggagctctctgtctgctntggattcattctttaagtaatcgtggctagttcgtcccgttggggtcccnccgtaggttcccacgggcccgacggggctaggagtggggtgaccagatatacaatagngtatagaaactaaagtaaaatactaactagtaggaacgtaccttacccgttaacggaaacgggtccctaattacccaaccttactacccgtacgaaagacgtaaacctaaacttaacccgaaaagaacgtagttagggttactaacttccgtagaacctaaaagtccgaactacgccctaggaacggacgacccgggaaagtaccggtaacggggtttattacgttaacggtaaggggtaaggtaaacgaaaccgttcgttaaaggccggtactaacg

SEQ ID NO: 305208 - DNA, 791 bp, Homo sapiens
  misc_feature: GZ8MTXP02F3D2I.10.71.G05.1.454.CMB.2.raw
  modified_base (206)..(206): a, c, t, g, unknown or other
  misc_feature (206)..(206): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgttctttgtctccgaaggggaaanacgcccaccctctcctgcgagggccagtcagtagtgttcgctacgttcggttaggggtgtatacgaaactataaacgtccggaccacggccctcccgaggtcctacctctacgtttcgtttgacttcgttacctttaccgaaccggtaccggggtccccctggggtccccgttaccccggacggtaccgtacgggtttaccgaggtcgggtaccgtacggggttcggggtcgtacgggggaaccttacggtaaccctttcgtacccttccctaccaaaccgtactaccgaacggtaccaacggtacccgttacgggaaccgtacccgttaaaggtaaaacgttttcgtttttacggaccttttaaaggtttttactttaccgttagtaccgtaaggtcacggttccggtcgtaccccggttacgtttcggggaaccggtcggttccgacccgtttaacgggttccgggggaaccgggtaaacgggtaaaaccctaaaagggttacggaaaccggtaaccgtaaaacggtacgtaggtacggcctaccgtaactacgtacttcttgttccttacctactttccccg

SEQ ID NO: 305209 - DNA, 711 bp, Homo sapiens
  misc_feature: GZ8MTXP02IFX27.10.71.G05.1.454.CMB.2.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtcttttgctccgaggggaaancgccaccctctcctgcagggccagtcagngtgttcgctacttcggtagggtgtatcaacataactccggacaggcctccgaggctcctntattctttgatgtctttacgaacgccggcctcggcgtccccgaggtcctacggttcaggtcgacgtagggttcggtacgtacgggactacgttaccttctaccttccacaaccctagtaccgacgtaccgacgtaacccgtaaggtaaccggtacccgttaaaggtaaacgttttacgttttaacgaccgttttaaaggttttaccttaacgttcgtacgaacgttccgaggttcccgtacgacccgtttacgggtttccgggcggggtacggtaccgtaccgttccggggttacgggaacgggtaaccggaaaaccttaaaaggggtcggtaaacgtaaaccggtaaaacggtcgttagggaccgtacgacgaaccgtaaactcgttactccggttaccttctaaccggtttccccg

SEQ ID NO: 305210 - DNA, 633 bp, Homo sapiens
  misc_feature: GZ8MTXP02I8RH5.10.71.G05.1.454.CMB.2.raw
  modified_base (390)..(390): a, c, t, g, unknown or other
  misc_feature (390)..(390): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtccctgagactctcctgtctgcgtctggattcatcttagtaaatctggcatgtccgtgggtcccgccgtacggttccgacggtcccgacggggtcgtagggaaagtggggtggaccgtaaggataaataactaaatagtagatagaactaagtaaaatntaactaagtaggagacttccgttacgaacggggtacccatttaccaacctactcctaccgaagacaaacttaataacctaaagaacaagttggttaatactcgtagaactaaagtccaacgacgtaccgaggaacgaccgacggaacggtacggtaacgggtttatttaaccgttagtagggtaggtaaacgtaaactccgttaaggcggtaacactacgtaccgttggttaaccgtttcggg

SEQ ID NO: 305211 - DNA, 662 bp, Homo sapiens
  misc_feature: GZ8MTXP02JYXAE.10.71.G05.1.454.CMB.2.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaangccacctctcctgcagggccagtcagagtgttcgcacttcggttagggtgtatcaacataaatccggcaggcctcccgaggcctcctctatctttgatgtctttacaacgcggccctggccgtcccgaggtcaggttcaggtcggcgtagggtcggggtcgtaggggacaggtaccttcaccgttctaccaaccntccgaggccaacgccctaggacgtccgtagtaacgttagtttcgacttaagttttattacgtgtacaggctaggcgtcgtccctacggtttcggggacgtagggttcgcccggttaacggtttccggggaccggggtaacgggtaaaacccgtaaaaggtaacgggtaaccgggtaaacgtaaaacgggtacgtagggtaccgggccttacgggaacccgtaaccgtacgttacctttcggtacctttaccgtacgtttcccccg

SEQ ID NO: 305212 - DNA, 602 bp, Homo sapiens
  misc_feature: GZ8MTXP02HV7Q8.10.71.G05.1.454.CMB.2.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (424)..(424): a, c, t, g, unknown or other
  misc_feature (424)..(424): n is a, c, g, or t
tcagcatagtagtgcacgaccggtgctcgatttagtgtcgtcgcaagagagagggggaggaactgctcagttaggacccagagggaaccatggaagcccccagctcagcttctcttcctcctgctactctggctcccagacaccaccggagaaattgtgttgacacagtctccagccacgctgtctttgctccgaggggaaangccaccctctcctgcagggccagtcagagtgttcgcattcggttaggggngtatcaacataaancgcagctccagctctcatctttgatgtctttacaaacgacgggtcccctggccgtcccaggcaggttcaggtggcaggtcgggtctggggacagtcttcactctacaccatcagcagcctagacgcctagaatagttttgactaagtttataacgtntacgaagcagtcgtgaccttacggtttcggacgggtaggtacgcccgtacggtttccgggacggggtaaaacgggaaaccctaaaaacggtaggtaaacgggtaaccgaaaaacgtaaaacgtgtaacgggctacggaaccgaaccgtaattcgtcttaccgtttactaccgtttccc

SEQ ID NO: 305213 - DNA, 567 bp, Homo sapiens
  misc_feature: GZ8MTXP02HNTS1.10.71.G05.1.454.CMB.2.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaancgccaccctntcctgcagggccagtcagagtgttcgctacttcggttagggtgtatcaacataaatccggcaggctcccaggcctcctcatctttgatgtctttacaacagggcccctggcctcccgaggctaggttcagtggcaggtggggtctggggactaggacctttcgacttcctacaccctataccaaggtcacgcccttaagacgtcctagtaagtattttcgactagtttatactgtcagtcagtcgtgctacgttcggcggtaggtcgcctacggtttcggacggtaggaacctaaaagtaggagtacgaaacgacgtgacggcctgaaccgactactacgtctcttcacttcccg

SEQ ID NO: 305214 - DNA, 573 bp, Homo sapiens
  misc_feature: GZ8MTXP02FU5WL.10.71.G05.1.454.CMB.2.raw
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggaaagcgccaccctctcctgcagggccagtcagagtgttcncgtacttcggttagggtggtatcgaactataaacgtccggccaggcctcccgaggccttccnctatctttcgatcgtctttacaactacgggtccccctgggccctccccgaggtccgtaggttcagttcggcaggtcgggtctgggacagtaccttcncttcncactatcaacgcacgctagacgcctagagtatttnacttagttatangtnagtnagcgtncctagttcggcgagtcaccgtacgttcggacggaacggtacaaaagttcgaaagggtacaaaacgtaacttggacgcctagaaccacacgttcncgtactacnctttcccg

SEQ ID NO: 305215 - DNA, 698 bp, Homo sapiens
  misc_feature: GZ8MTXP02JMDA2.10.71.G05.1.454.CMB.2.raw
  modified_base (607)..(607): a, c, t, g, unknown or other
  misc_feature (607)..(607): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtgggttttcctcgttgctacttttaagagatgtccagtgtcagatgcagagtgggtggaggtcggtgggggaggcggtcgggtcccgggtccgggttcggggggtcccctaggacgtccgtcccgttccgttcgttctcggtcgttaccgtgggatttacactttacgtttaagtaaacttcgtggctagtcgtccggtcgggtcccgaccgtacggttccgaacgggtcccggaacggggtcgtagggtaggtcggggtgacccgtagaataataacaattagtacgagtaagaaacgtaaaaggttaaaattaagttaaacgtaagtagggtaaaccgttacgtacccgttggaaaacggggtccctagttacccaccgtatcctacgagaactaaactacttaaccgaaagaataggtaggtactatcgaacgtataacgtacgaaccncgaccgtaggaacggaccgttaccggaaggaccgtacggggtttcttaagttagtggaaggtaactacgtcggtagtcggactttaaccgg

SEQ ID NO: 305216 - DNA, 645 bp, Homo sapiens
  misc_feature: GZ8MTXP02G0UBM.10.71.G05.1.454.CMB.2.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (309)..(309): a, c, t, g, unknown or other
  misc_feature (309)..(309): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagatggtggngtgtgggggagcgtggtccggcgtgggggtccctgagctctctgtcngcgtctggattcattactttagtaaatcgtgcattcgtccgtcggggtcccncgtaacggttccgacggcccgacgggtcgtagggaaaggtcggggtagcgtagatanacaaatagcgtagtagacgtaaagtaaaatataacgtatcggaactacctaccgttagaacgggtaccctagttaccacctaatccctaccgaaagtaacgaaactaactaaaccgaagtaaactgtagtagttacttaccgagaaacctaaagccgtaaacgacgtaccgagaacggacggaccgggaaaggtaccggtaagggggttttactttaaagttaccggtaggtaagggtaaacgtaaacgttaccgtaggtcggactacgtacgtaacgg

SEQ ID NO: 305217 - DNA, 717 bp, Homo sapiens
  misc_feature: GZ8MTXP02FSZUN.10.71.G05.1.454.CMB.2.raw
  modified_base (258)..(258): a, c, t, g, unknown or other
  misc_feature (258)..(258): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtcggggtcctgagctctctgtcngcgtctggtattcattacgtttaagtaaactcgtggtactagttcggtcccgtggggtccccgtccgtacggttccgacgggcccgacggggtcgtagggaaggttggggtcggaccgtagtataataaactaatagttagtagtaggtaaactaaaaggttaaaactattaacgtaaggtaggaaacgtacccttacccgttacgaacggggtacctagttacccaacctataccctacgaaagacgtaaactaaactaccgaaaacgtaacgtagttacgggtataacgtcgtaacgacgtaaaacgtccgaacgtacgtaccgtaggaaacggaccgtacccgggaaacgggtaaaccggttaccgggggttttaaatttaacccggttaaacggtaaggggttaacggggaaaacgttaaacccgttacgtacgggtacggtaccttaaaaccgg

SEQ ID NO: 305218 - DNA, 514 bp, Homo sapiens
  misc_feature: GZ8MTXP02FFPCL.10.71.G05.1.454.CMB.2.raw
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagttttgggctgagctgggtttttcctcgttgctctttttaagagatgtccagtgtcagatgcagatggtggagtcgtggggggagcgtggtccggccgtgggggtccctgagactctcctgttctgcgtctggattcatctttagtaaatctggcatgtcctggggtccgccaggttcccagggcccacggggctggaatggggtgccagatatacaatatgatgacagtaaaatatactatgagactccttcaagggccgattcacatctccagagacaattccaagaacatggtgtatctagacaaatgaccagcctagagagccgaggacacggggttntttatacngtggagaaatcctagtcgctacg

SEQ ID NO: 305219 - DNA, 558 bp, Homo sapiens
  misc_feature: GZ8MTXP02H1LAX.10.71.G05.1.454.CMB.2.raw
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctggagactctcctgttctgcgtctggattcatcttagtaaatctggcatgtcctgggtcccgccgtaggttcccgacggccacggggctggaagtgggtggcagatatacaatatgatgacaagtaaaatntaactatagganactctacaagggcctatcacatcncagacaanaactaccaaagaacattagtagtatctgacaaaatgaccaagcctagagacgacgaagacgtacgggttgtttaacttaacgtggttacgggaagtaaacgttaccgtaaggtcggactacgtctaaccgttgggttaatttcgg

SEQ ID NO: 305220 - DNA, 649 bp, Homo sapiens
  misc_feature: GZ8MTXP02GSJZ9.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtaagatgcagagtggtggagtcgtgggggaggcgtgggtccggcgtcgggggtcctgagctctctgtctgcgtctggtattcattactttagtaaatcgtggctagtcgtccgtcgggtcccgccgtagggttcccgacggcccgacggggtcgtagggaaggtcggggtggacaaggtaatataaactaatatagattagaaactaaaagttaaaattatacgtagtaggaacgtaccttaccgttacgaaacgggtcccgtaattacccgaacctatcctacgaagaacgaactaacttaaccaaagaactagttagtagtaatcgtagaactaacgtacaccgacgtccgaggacggaacggaccggaaaggacgtaacgggtttatttaacgtacggttagggtaagggtaacgtaaactcgtaagtcggactaacgtcgtaacgtgtacgttggtaccgg
